(12) United States Patent
Sugiyama

(10) Patent No.: US 9,803,246 B2
(45) Date of Patent: Oct. 31, 2017

(54) RECEPTOR GENE FOR PEPTIDE CANCER ANTIGEN-SPECIFIC T CELL

(75) Inventor: Haruo Sugiyama, Osaka (JP)

(73) Assignee: International Institute of Cancer Immunology, Inc., Suita-shi (JP)

(*) Notice: Subject to any disclaimer, the term of this patent is extended or adjusted under 35 U.S.C. 154(b) by 0 days.

(21) Appl. No.: 14/129,695

(22) PCT Filed: Jun. 20, 2012

(86) PCT No.: PCT/JP2012/065707
§ 371 (c)(1),
(2), (4) Date: Dec. 27, 2013

(87) PCT Pub. No.: WO2013/002086
PCT Pub. Date: Jan. 3, 2013

(65) Prior Publication Data
US 2014/0255941 A1    Sep. 11, 2014

(30) Foreign Application Priority Data
Jun. 28, 2011  (JP) ................. 2011-143273

(51) Int. Cl.
| | | |
|---|---|---|
| *C12Q 1/68* | (2006.01) | |
| *C07K 14/725* | (2006.01) | |
| *G01N 33/574* | (2006.01) | |
| *C07K 16/30* | (2006.01) | |
| *C07K 16/28* | (2006.01) | |
| *G01N 33/569* | (2006.01) | |
| *C07H 21/02* | (2006.01) | |
| *C07H 21/04* | (2006.01) | |
| *C12P 21/02* | (2006.01) | |

(52) U.S. Cl.
CPC ........ *C12Q 1/6886* (2013.01); *C07K 14/7051* (2013.01); *C07K 16/2809* (2013.01); *C07K 16/30* (2013.01); *C12Q 1/686* (2013.01); *C12Q 1/6881* (2013.01); *G01N 33/56977* (2013.01); *G01N 33/574* (2013.01); *C07K 2317/34* (2013.01); *C07K 2317/565* (2013.01); *C12Q 2600/106* (2013.01); *C12Q 2600/158* (2013.01); *G01N 2333/7051* (2013.01)

(58) Field of Classification Search
None
See application file for complete search history.

(56) References Cited

U.S. PATENT DOCUMENTS

| | | |
|---|---|---|
| 4,923,799 A | 5/1990 | Mak |
| 5,512,478 A | 4/1996 | Orser et al. |
| 6,013,444 A | 1/2000 | Dau et al. |
| 6,225,051 B1 | 5/2001 | Sugiyama |
| 6,582,908 B2 | 6/2003 | Fodor et al. |
| 2002/0131960 A1 | 9/2002 | Sadelain et al. |
| 2004/0097703 A1 | 5/2004 | Sugiyama |
| 2004/0247609 A1 | 12/2004 | Sugiyama |
| 2005/0002951 A1 | 1/2005 | Sugiyama et al. |
| 2005/0266014 A1 | 12/2005 | Sugiyama et al. |
| 2006/0035291 A1 | 2/2006 | Itoh et al. |
| 2007/0082860 A1 | 4/2007 | Sugiyama et al. |
| 2007/0238099 A1 | 10/2007 | Cohen et al. |
| 2008/0070835 A1 | 3/2008 | Sugiyama |
| 2008/0152631 A1 | 6/2008 | Sugiyama |
| 2009/0099090 A1 | 4/2009 | Sugiyama et al. |
| 2010/0190163 A1 | 7/2010 | Sugiyama |
| 2014/0255941 A1 | 9/2014 | Sugiyama |
| 2014/0315735 A1 | 10/2014 | Sugiyama |
| 2014/0315758 A1 | 10/2014 | Sugiyama |

FOREIGN PATENT DOCUMENTS

| | | |
|---|---|---|
| CN | 101668853 A | 3/2010 |
| EP | 1 410 804 A1 | 4/2004 |
| EP | 1 447 091 A1 | 8/2004 |
| EP | 1 473 564 A1 | 11/2004 |
| EP | 1 536 009 A1 | 6/2005 |
| EP | 1 550 453 A1 | 7/2005 |
| EP | 1 640 458 A1 | 3/2006 |
| EP | 2 116 596 A1 | 11/2009 |
| JP | 2001-517958 A | 10/2001 |
| JP | 2002-515243 A | 5/2002 |
| JP | 2002-525099 A | 8/2002 |
| JP | 2003-500004 | 1/2003 |
| JP | 2009-278927 A | 12/2009 |
| KR | 2002-0013503 | 2/2002 |
| WO | 93/04695 A1 | 3/1993 |
| WO | 98/54223 A2 | 12/1998 |

(Continued)

OTHER PUBLICATIONS

Pinilla-Ibarz et al., "Improved human T-cell responses against synthetic HLA-0201 analog peptides derived from the WT1 oncoprotein" 20 Leukemia 2025-2033 (2006).*

Ochsenreither et al., "Wilms Tumor Protein 1 (WT1) Peptide Vaccination-induced Complete Remission in a Patient With Acute Myeloid Leukemia Is Accompanied by the Emergence of a Predominant T-cell Clone Both in Blood and Bone Marrow" 34(1) Journal of Immunotherapy 85-91 (Jan. 2011).*

Kruger et al., "Lessons to be learned from primary renal cell carcinomas: novel tumor antigens and HLA ligands for immunotherapy" 54 Cancer Immunology and Immunotherapy 826-836 (2005).*

Robinson et al., "IMGT/HLA Database—a sequence database for the human majore histocompatibility complex" 55 Tissue Antigens 280-287 (2000).*

(Continued)

*Primary Examiner* — Nancy J Leith
(74) *Attorney, Agent, or Firm* — Oblon, McClelland, Maier & Neustadt, L.L.P.

(57) ABSTRACT

The invention provides the nucleotide sequence and amino acid sequence of the CDR3 domain of the T cell receptor (TCR) gene of a WT1-specific cytotoxic T cell (CTL) against WT1 protein. Also provided are a method for testing for and treating cancer using the nucleotide sequence and amino acid sequence, and a chip, primer set, kit, and device for testing for cancer comprising the nucleotide sequence and amino acid sequence.

10 Claims, 22 Drawing Sheets

(56) References Cited

FOREIGN PATENT DOCUMENTS

| WO | 99/27957 A1 | 6/1999 |
|---|---|---|
| WO | 99/60119 A2 | 11/1999 |
| WO | 00/18795 A2 | 4/2000 |
| WO | 00/26249 A1 | 5/2000 |
| WO | 00/50641 A1 | 8/2000 |
| WO | 02/28414 A1 | 4/2002 |
| WO | 02/079253 A1 | 10/2002 |
| WO | 03/002142 A1 | 1/2003 |
| WO | 03/025569 A1 | 3/2003 |
| WO | 03/028757 A1 | 4/2003 |
| WO | 03/037060 A2 | 5/2003 |
| WO | 03/059155 A2 | 7/2003 |
| WO | 03/106682 A1 | 12/2003 |
| WO | 2005/053603 A2 | 6/2005 |
| WO | 2005/116074 A2 | 12/2005 |
| WO | WO 2006/064176 A1 | 6/2006 |
| WO | WO 2008/026927 A2 | 3/2008 |
| WO | 2008 108257 | 9/2008 |

OTHER PUBLICATIONS

Combined Chinese Office Action and Search Report issued Nov. 4, 2014 in Patent Application No. 201280042412.0 (with English language translation).
Partial Supplementary European Search Report issued Nov. 27, 2014 in Patent Application No. 12803980.7.
Partial Supplementary European Search Report issued Jan. 5, 2015 in Patent Application No. 12803980.7.
Sebastian Ochsenreither, ""Wilms Tumor Protein 1" (WT1) Peptide Vaccination-induced Complete Remission in a Patient With Acute Myeloid Leukemia Is Accompanied by the Emergence of a Predominant T-cell Clone Both in Blood and Bone Marrow" Journal of Immunotherapy, vol. 34, No. 1, XP009181179, Jan. 2011, pp. 85-91.
Sebastian Ochsenreither, "Wilms' tumor protein 1 (WT1) peptide vaccination in AML patients: predominant TCR CDR3β sequence associated with remission in one patient is detectable in other vaccinated patients" Cancer Immunol Immunother, vol. 61, XP35018866, 2012, pp. 313-322.
International Report on Patentability issued in corresponding PCT/JP2012/065707 dated Jan. 7, 2014 (w/English translation).
Office Action issued in U.S. Appl. No. 12/529,701 dated Feb. 1, 2012.
Hirschhorn et al. "A comprehensive review of genetic association studies", Genetics in Medicine, Mar./Apr. 2002, vol. 4, No. 2, pp. 45-61.
Ioannidis et al. "Replication validity of genetic association studies", Nature Genetics, vol. 29, Nov. 2001, pp. 306-309.
Office Action issued in U.S. Appl. No. 12/529,701 dated Aug. 8, 2012.
Office Action issued in U.S. Appl. No. 12/529,701 dated Aug. 22, 2013.
Office Action issued in U.S. Appl. No. 12/529,701 dated Feb. 14, 2014.
O'Keefe et al. "Molecular Analysis of TCR Clonotypes in LGL: A Clonal Model for Polyclonal Responses", The Journal of Immunology, 2004, vol. 172, No. 3, pp. 1960-1969.
Farina et al. "Conserved TCR usage by HLA-Cw*1601-restricted T cell clones recognizing melanoma antigens", International Immunology, 1996, vol. 8, No. 9, pp. 1463-1466.
Oka et al. "Wilms Tumor Gene Peptide-Based Immunotherapy for Patients with Overt Leukemia from Myelodysplastic Syndrome (MDS) or MDS with Myelofibrosis", International Journal of Hematology, 2003, vol. 78, No. 1, pp. 56-61.
Oka et al. "Induction of WT1 (Wilms' tumor gene)-specific cytotoxic T lymphocytes by WT1 peptide vaccine and the resultant cancer regression", Proc. The National Academy of Sciences of the USA, Sep. 21, 2004, vol. 101, No. 38, pp. 13885-13890.
Extended European Search Report issued in corresponding EP application No. 08720964.9 dated Mar. 5, 2010.
Coppage et al. "In vitro generation of tumor specific T cells that recognize a shared antigen of AML: Molecular characterization of TCR genes", Leukemia Research 31, 2007, pp. 195-202.
Zhou et al. Database Genbank, 2003, XP-002569162.
Rezvani et al. "T-Cell Responses Directed against Multiple HLA-A*0201-Restricted Epitopes Derived from Wilms' Tumor 1 Protein in Patients with Leukemia and Healthy Donors: Identification, Quantification, and Characterization", Clinical Cancer Research Dec. 15, 2005, vol. 11, No. 24, pp. 8799-8807.
Ohminami et al. "HLA class I-restricted lysis of leukemia cells by a CD8+ cytotoxic T-lymphocyte clone specific for TW1 peptide", Blood, Jan. 1, 2000, vol. 95, No. 1 XP 002190642, pp. 286-293.
Halapi et al. "T cell receptor usage in malignant diseases", Springer Seminars in Immunopathology (1999), vol. 21, No. 1, pp. 19-35 XO-002568655.
Office Action issued in European patent application No. 08720964.9 dated May 10, 2011.
Correspondence dated Nov. 15, 2012 forwarding and describing the Office Action issued in Mexican patent application No. MX/A/2009/009589.
Office Action issued in European patent application No. 08720964.9 dated Oct. 15, 2012.
Office Action issued in Australian patent application No. 2008222061 dated Nov. 27, 2012.
Xue et al. "Elimination of human leukemia cells in NOD/SCID mice by WT1-TCR gene-transduced human T cells", Blood, 2005, 106, pp. 3062-3067.
Armstrong et al. "Conformational changes and flexibility in T-cell receptor recognition of peptide-MHC complexes", Biochem J., 2008, 415, pp. 183-196.
Office Action issued in Japanese patent application No. 2009-502541 dated Apr. 16, 2013 and partial English translation.
Office Action issued in Australian patent application No. 2008222061 dated May 31, 2013.
Office Action issued in Australian patent application No. 2008222061 dated Oct. 23, 2013.
T cell receptor beta chain variable region [Homo sapiens], GenBank: ABF14434.1, 2006.
T cell receptor beta chain [Homo sapiens], GenBank: BAC01035.1, 2002.
"AICAR transformylase PurH [Helicobacter hepaticus ATCC 51449", GenBank: AAP77080.1, Mar. 11, 2010.
"Homo sapiens T cell receptor beta chain (BV16S1) mRNA, partial cds", GenBank: AF317601.1, 2001.
"T-cell receptor beta-chain [Homo sapiens]", GenBank CAC06601.1, 2001.
"T cell receptor beta chain [Homo sapiens]", GenBank: AAG15764.1, 2000.
"T cell receptor beta chain, partial [Homo sapiens]", GenBank: AAC52008.1, 1998.
Office Action issued in Australian patent application No. 2008222061 dated Dec. 20, 2013.
Abbey et al., "Expression of T-cell receptor genes during early T-cell development", Immunology and Cell Biology, 2008, 86, pp. 166-174.
Office Action issued in Japanese patent application No. 2009-502541 dated Feb. 4, 2014 with partial English translation.
U.S. Appl. No. 14/184,979, filed Feb. 20, 2014, Sugiyama.
U.S. Appl. No. 14/184,816, filed Feb. 20, 2014, Sugiyama.
Kato,T., et al., "Analysis of Accumulated T Cell Clonotypes in Patients with Systemic Lupus Erythematosus", Arthritis & Rheumatism, vol. 43, No. 12, pp. 2712-2721, (Dec. 2000).
Valmori, D., et al., "Vaccination with a Melan-A Peptide Selects an Oligoclonal T Cell Population with Increased Functional Avidity and Tumor Reactivity", The Journal of Immunology, vol. 168, pp. 4231-4240, (2002).
Dietrich, P., et al., "Melanoma Patients Respond to a Cytotoxic T Lymphocyte-defined Self-Peptide with Diverse and Nonoverlapping T-Cell Receptor Repertoires", Cancer Research, vol. 61, pp. 2047-2054, (Mar. 1, 2001).

(56) References Cited

OTHER PUBLICATIONS

Coulie, P. G., et al., "A monoclonal cytolytic T-lymphocyte response observed in a melanoma patient vaccinated with a tumor-specific antigenic peptide encoded by gene MAGE-3", vol. 98, No. 18, pp. 10290-10295, (Aug. 28, 2001).

Godelaine, D., et al., "Polyclonal CTL Responses Observed in Melanoma Patients Vaccinated with Dendritic Cells Pulsed with a MAGE-3.A1 Peptide", The Journal of Immunology, vol. 171, pp. 4893-4897, (2003).

Madruzzato, S., et al., "Large and Dissimilar Repertoire of Melan-A/MART-1-Specific CTL in Metastatic Lesions and Blood of a Melanoma Patient", The Journal of Immunology, vol. 169, pp. 4017-4024, (2002).

International Search Report Issued Aug. 7, 2012 in PCT/JP12/065707 Filed Jun. 20, 2012.

Office Action issued May 6, 2014 in European Patent Application No. 08720964.9.

Second Office Action and Search Report dated Jul. 16, 2015, issued in corresponding Chinese patent application No. 201280042412.0 (with English translation).

Borbulevych et al.—"Structures of native and affinity-enhanced WT1 epitopes bound to HLA-A*0201: implications for WT1-based cancer therapeutics", *Mol Immunol*. Sep. 2010 47(15), pp. 2519-2524.

GenBank Accession No. AAM92197, T-cell receptor beta chain variable region, partial [*Homo sapiens*]. Published Aug. 10, 2002.

Patent Examination Report dated Jun. 4, 2015 issued in Australian patent application No. 2013270605.

Patent Examination Report dated Jun. 4, 2015 issued in Australian patent application No. 2013206501.

Willenbrock et al.—"Analysis of T-Cell Subpopulations in T-Cell Non-Hodgkin's Lymphoma of Angioimmunoblastic Lymphadenopathy with Dysproteinemia Type by Single Target Gene Amplification of T Cell Receptor-β Gene Rearrangements", American Journal of Pathology, vol. 158, No. 5, May 2001, pp. 1851-1857.

Yasukawa, *Ketsueki, Shuyou-ka*, vol. 51, No. 3, 2005, pp. 320-326 with partial English translation.

Schumacher—"T-Cell-Receptor Gene Therapy", *Nature Reviews Immunology*, vol. 2, Issue 7, Jul. 2002.

Sugiyama—"Wilms' Tumor Gene WT1: Its Oncogenic Function and Clinical Application", International Journal of Hematology 73 (2001), pp. 177-187.

Rezvani et al.—"Functional leukemia-associate antigen-specific memory CD8+ T cells exist in healthy individuals and in patients with chronic myelogenous leukemia before and after stem cell transplantation", 2003.

Oka et al.—"WT1 as a Novel Target Antigen for Cancer Immunotherapy", Current Cancer Drug Targets, 2002, vol. 2, pp. 45-54.

Oka et al.—"Cancer Immunotherapy Targeting Wilms' Tumor Gene WT1 Product", The Journal of Immunology, 2000, vol. 164, pp. 1873-1880.

Borrello et al.—"Cancer Vaccines for Hematologic Malignancies", Cancer Control, Mar./Apr. 2002, vol. 9, No. 2, pp. 138-.

Maeda et al.—"Detection of peptide-specific CTL-precursors in peripheral blood lymphocytes of cancer patients", British Journal of Cancer (2002) vol. 87,No. 7, pp. 796-804.

Tsuboi et al.—"WT1 Peptide-Based Immunotherapy for Patients with Lung Cancer: Report of Two Cases", Microbiol. Immunol., 48(3), pp. 175-184, 2004.

Tsuboi et al.—"Enhanced induction of human WT1-specific cytotoxic T lymphocytes with a 9-mer WT1 peptide modified at HLA-A*2402-binding residues", (1996), vol. 274, pp. 94-96, XP003016309.

Herr et al.—"Frequency analysis of tumor-reactive cytotoxic T lymphocytes in peripheral blood of a melanoma patient vaccinated with autologous tumor cells", Cancer Immunol Immunother (1994) 39, pp. 93-99.

Whiteside—"Monitoring of Antigen-Specific Cytolytic T Lymphocytes in Cancer Patients Receiving Immunotherapy", Clinical and Diagnostic Laboratory Immunology, vol. 7, No. 3, May 2000, pp. 327-332.

Extended European Search Report dated Oct. 31, 2011 issued in EP 11154327.8.

Extended European Search Report dated Jul. 1, 2011 issued in EP 11154325.2.

Moller et al.—"Vaccination with IL-7 gene-modified autologous melanoma can enhance the anti-melanoma lytic activity in peripheral blood of patients with a good clinical performance status: a clinical phase I study", British Journal of Cancer (1998) 77(11), pp. 1907-1916.

Menke et al.—"The Wilms' Tumor 1 Gene: Oncogene or Tumor Suppressor Gene?", International Review of Cytology, vol. 181, pp. 151-212, 1998.

Altman et al.—Phenotypic Analysis of Antigen-Specific T Lymphocytes, Science vol. 274, Oct. 4, 1996, pp. 94-96.

Kruse et al.—Quantification of cytokine mRNA expression by RT PCR in samples of previously frozen blood, Journal of Immunological Methods 210 (1997), pp. 195-203.

Czerkinsky et al.—"Reverse ELISPOT assay for clonal analysis of cytokine production", Journal of Immunological Methods, 110 (1988), pp. 29-36.

Sugiyama—"Cancer Immunotherapy Targeting WT1 Protein", International Journal of Hematology 76 (2002) pp. 127-132.

Gessler et al.—"Homozygous deletion in Wilms tumours of a zinc-finger gene identified by chromosome jumping", Nature, vol. 343, Feb. 22, 1990, pp. 774-778.

Call et al.—"Isolation and Characterization of a Zinc Finger Polypeptide Gene at the Human Chromosome 11 Wilms' Tumor Locus", Cell, vol. 60, pp. 509-520, Feb. 9, 1990.

Nagai et al.—Increased Activated Human T Cell Lymphotropic Virus Type I (HTLV-I), Tax11-19-Specific Memory and Effector CD8+ Cells in Patients with HTLV-I-Associated Myelopathy/Tropical Spastic Paraparesis: Correlation with HTLV-I Provirus Load, Journal of Infectious Diseases, 2001, 183, pp. 197-205.

Oertli et al.—Rapid Induction of Specific Cytotoxic T Lymphocytes Against Melanoma-Associated Antigens by a Recombinant Vaccinia Virus Vector Expressing Multiple Immunodominant Epitopes and Costimulatory Molecules In Vivo, Human Gene Therapy 13, pp. 569-575, Mar. 1, 2002.

Lau et al.—"Phase I Trial of Intravenous Peptide-Pulsed Dendritic Cells in Patients with Metastatic Melanoma", Journal of Immunotherapy, 24, 1, pp. 66-78, 2001.

European Search Report dated May 12, 2015 issued in European patent application No. 12803980.7.

European Search Report dated Mar. 18, 2015 issued in European patent application No. 14192034.8.

Kasprowicz et al.—"A Highly Restricted T-Cell Receptor Dominates the CD8+ T-Cell Response to Parvovirus B19 Infection in HLA-A*2402-Positive Individuals", Journal of Virology, vol. 80, No. 13, Jul. 2006, pp. 6697-6701.

Office Action dated Aug. 20, 2015, issued in U.S. Appl. No. 14/184,816.

Office Action dated Nov. 16, 2015 issued in U.S. Appl. No. 14/687,628, filed Apr. 15, 2015).

Office Action mailed Dec. 2, 2015 in co-pending U.S. Appl. No. 10/562,486.

Gotoh et al., "Development of HLA-A2402/Kb Transgenic Mice", Int. J. Cancer: 100, 565-570 (2002).

Decision on Rejection dated Feb. 14, 2016 issued in corresponding Chinese patent application No. 201280042412.0 (with English translation).

Office Action mailed Apr. 26, 2016 issued in corresponding Japanese patent application No. 2013-522787 with English translation.

Summons dated May 2, 2016 issued in corresponding European patent application No. 08720964.9.

Office Action dated May 12, 2016 issued in U.S. Appl. No. 14/687,628.

Office Action dated Jul. 12, 2016 issued in corresponding Japanese patent application No. 2015-151065 (with partial English translation).

(56) References Cited

OTHER PUBLICATIONS

Office Action dated Mar. 24, 2016 issued in corresponding Korean patent application No. 10-2015-7023123 (with partial English translation).
Final Office Action dated Dec. 2, 2016 issued in U.S. Appl. No. 14/687,628, filed Apr. 15, 2015.
Office Action dated Dec. 5, 2016 issued in European Patent Application No. 12803980.7, which is related to U.S. Appl. No. 14/129,695.
Non-Final Office Action dated Nov. 2, 2016 issued in related U.S. Appl. No. 14/184,816.
Non-Final Office Action dated Aug. 8, 2016 issued in corresponding U.S. Appl. No. 14/687,569.
Office Action dated Feb. 9, 2017 issued in corresponding Chinese patent application No. 201280042412.0 (with English translation).
Final Office Action dated Feb. 9, 2017 issued in related U.S. Appl. No. 14/184,979.
Sommer et al.—"Minimal homology requirements for PCR primers", Nucleic Acids Research, vol. 17, No. 16, 1989.
Office Action dated Jan. 27, 2017 issued in related U.S. Appl. No. 14/687,569.
Final Office Action dated May 9, 2017 issued in related U.S. Appl. No. 14/184,816.
Final Office Action dated May 10, 2017 issued in related U.S. Appl. No. 12/529,701.
Office Action dated Jul. 18, 2017 issued in corresponding Japanese patent application No. 2015-151065 (with English translation).
Non-Final Office Action dated Aug. 24, 2017 issued in related U.S. Appl. No. 14/687,628.
Office Action dated Aug. 22, 2017 issued in corresponding Japanese patent application No. 2016-193222 (with English translation).

\* cited by examiner

Figure 1-1:
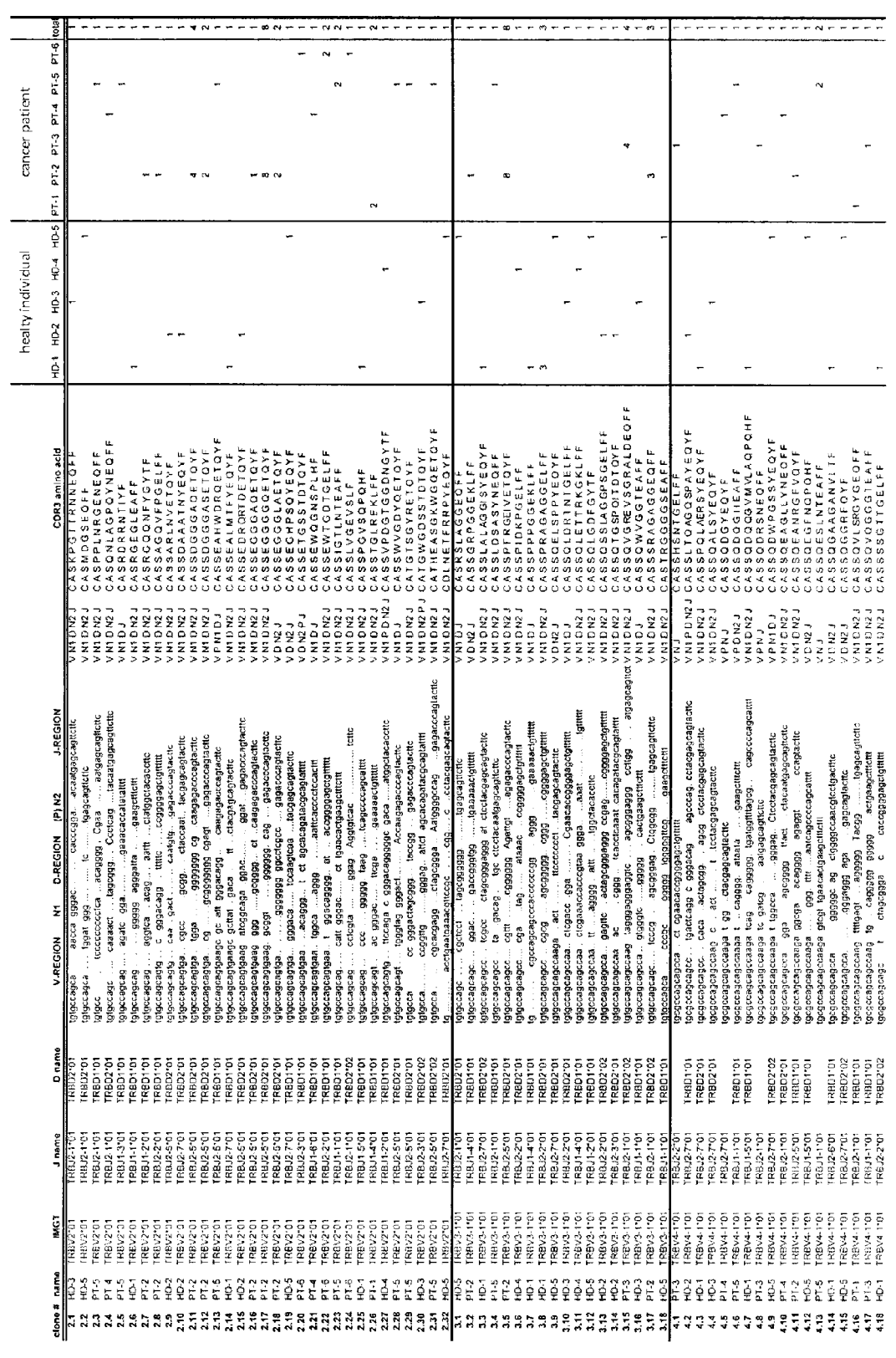

Figure 1-2:
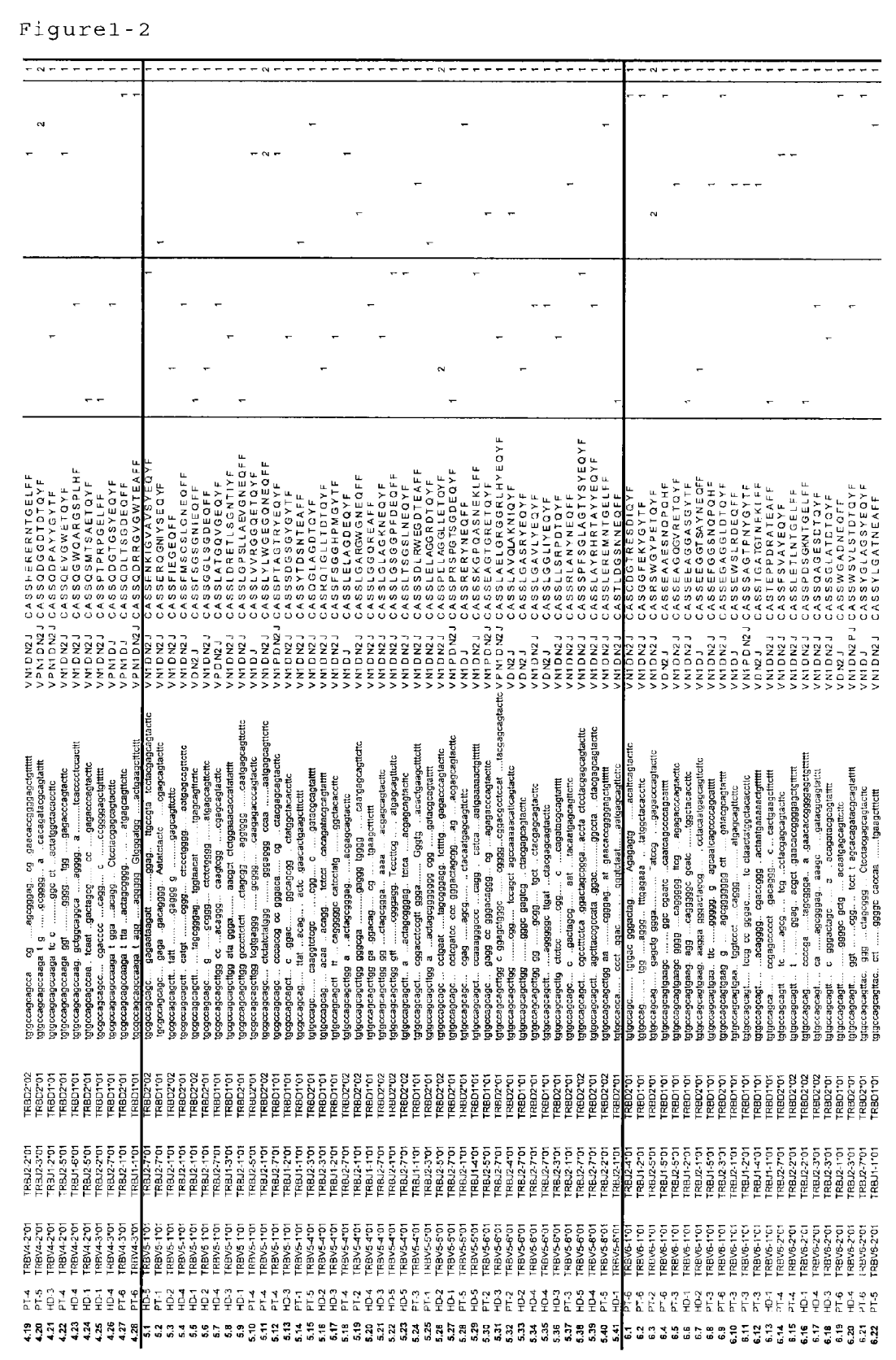

Figure 1-3:
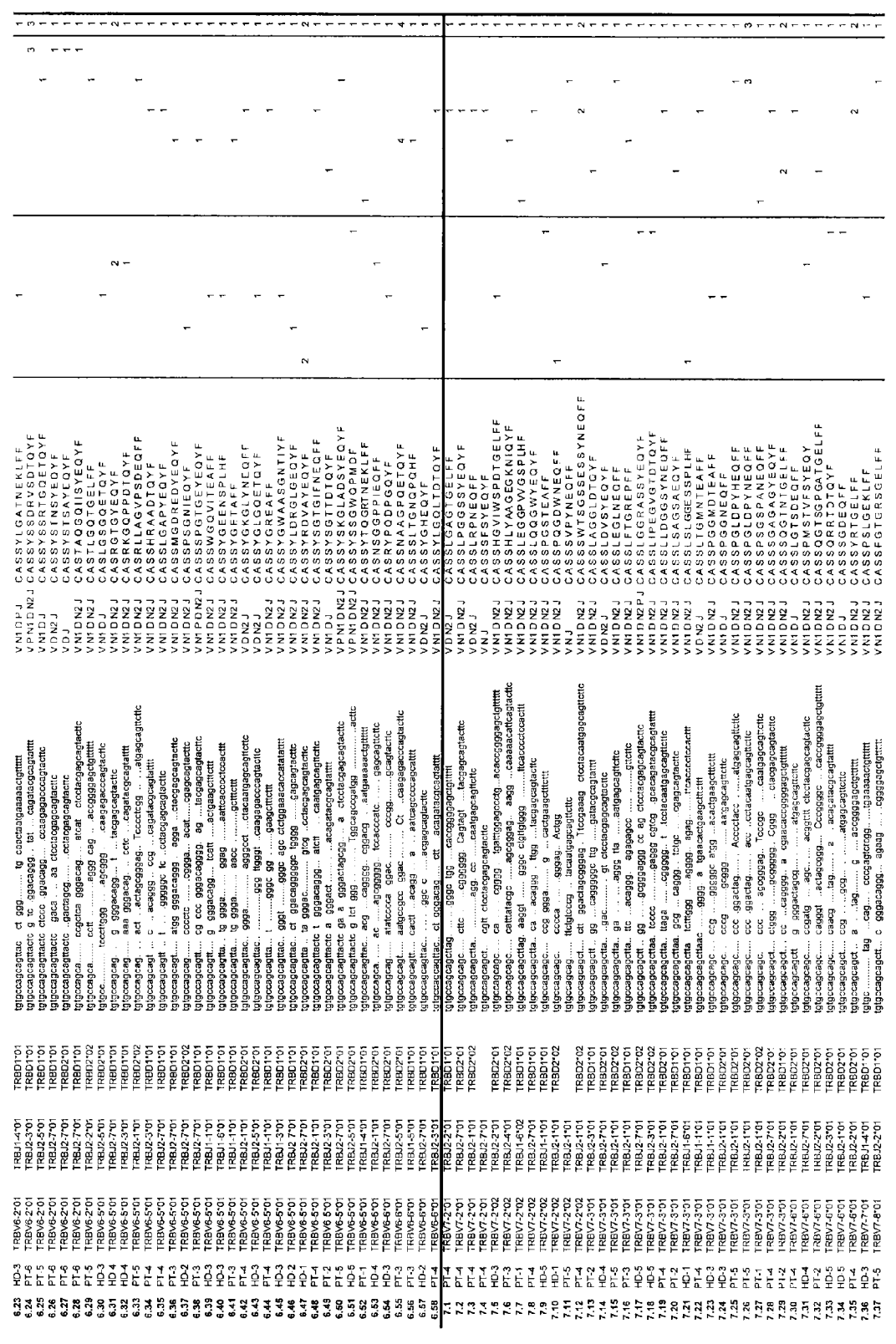

Figure 1-4:
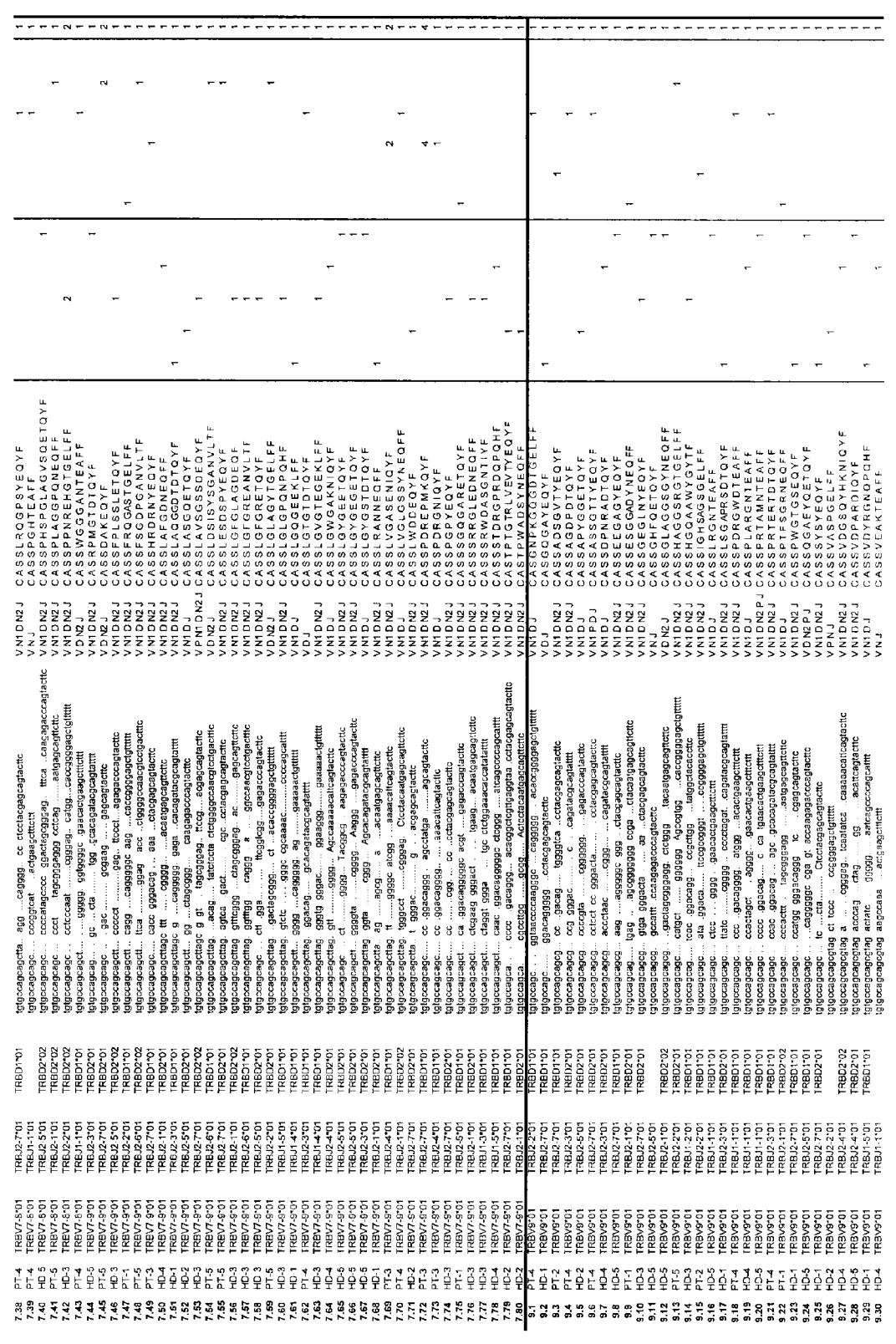

Figure 1-5:
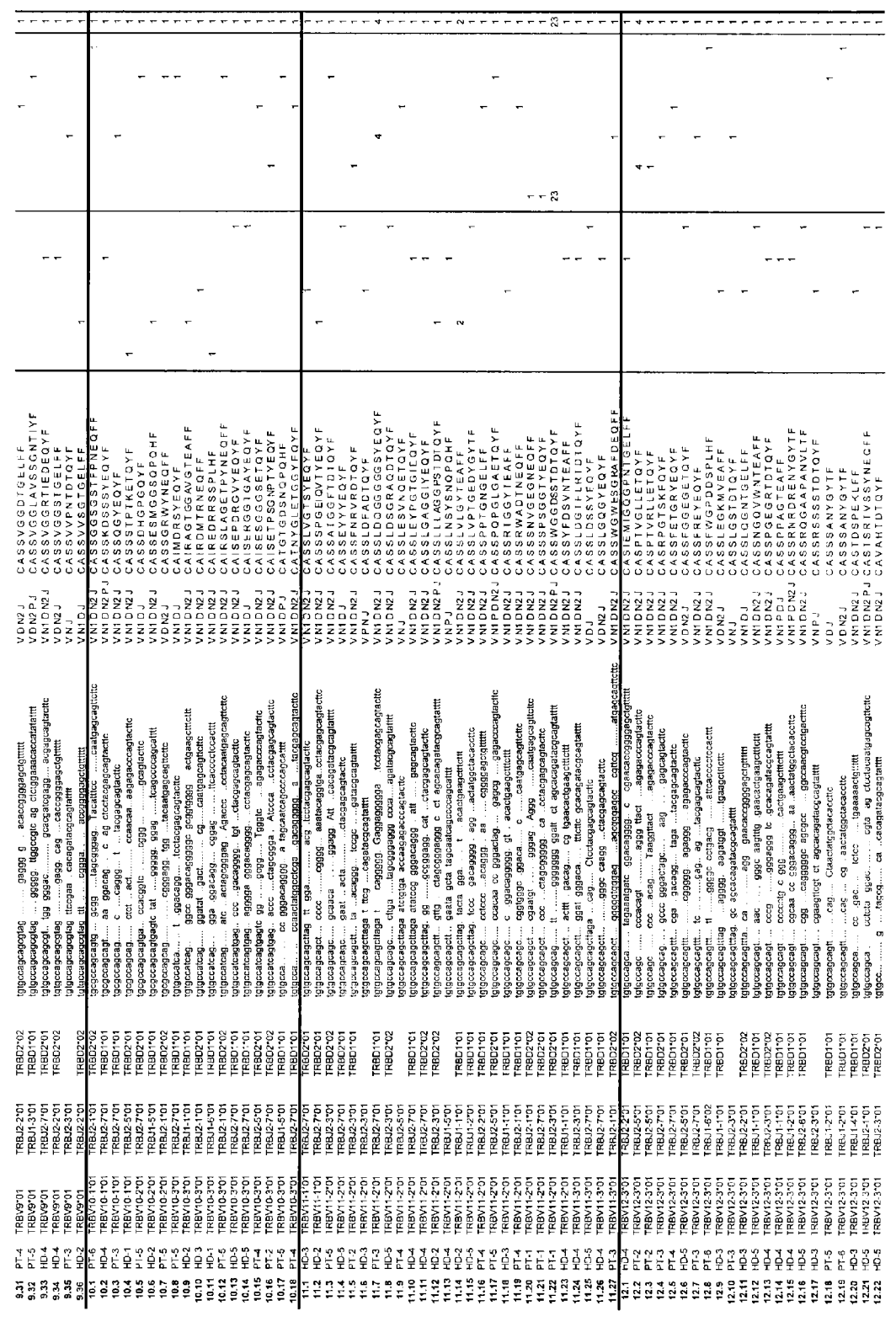

Figure 1-6:
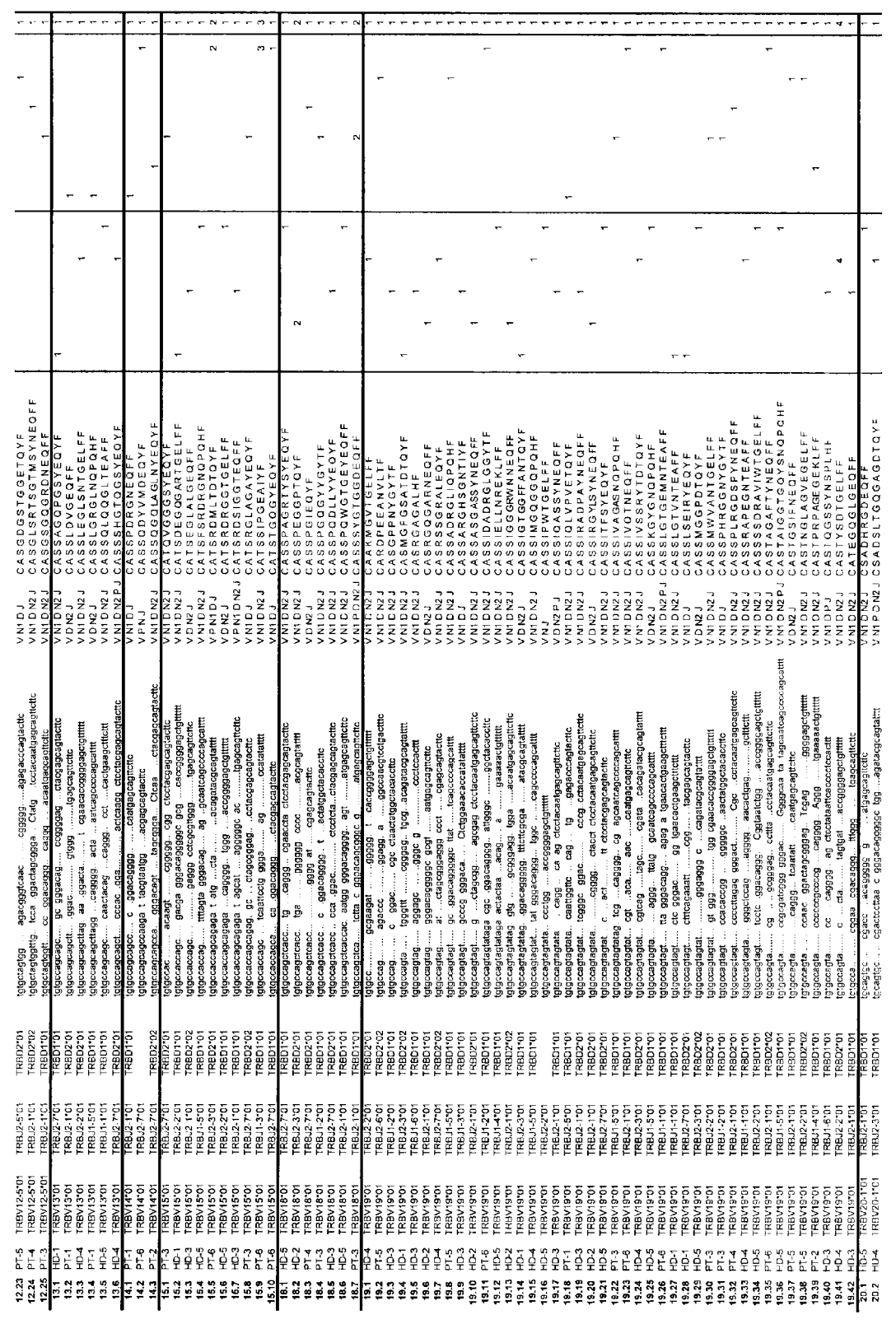

Figure 1-8:
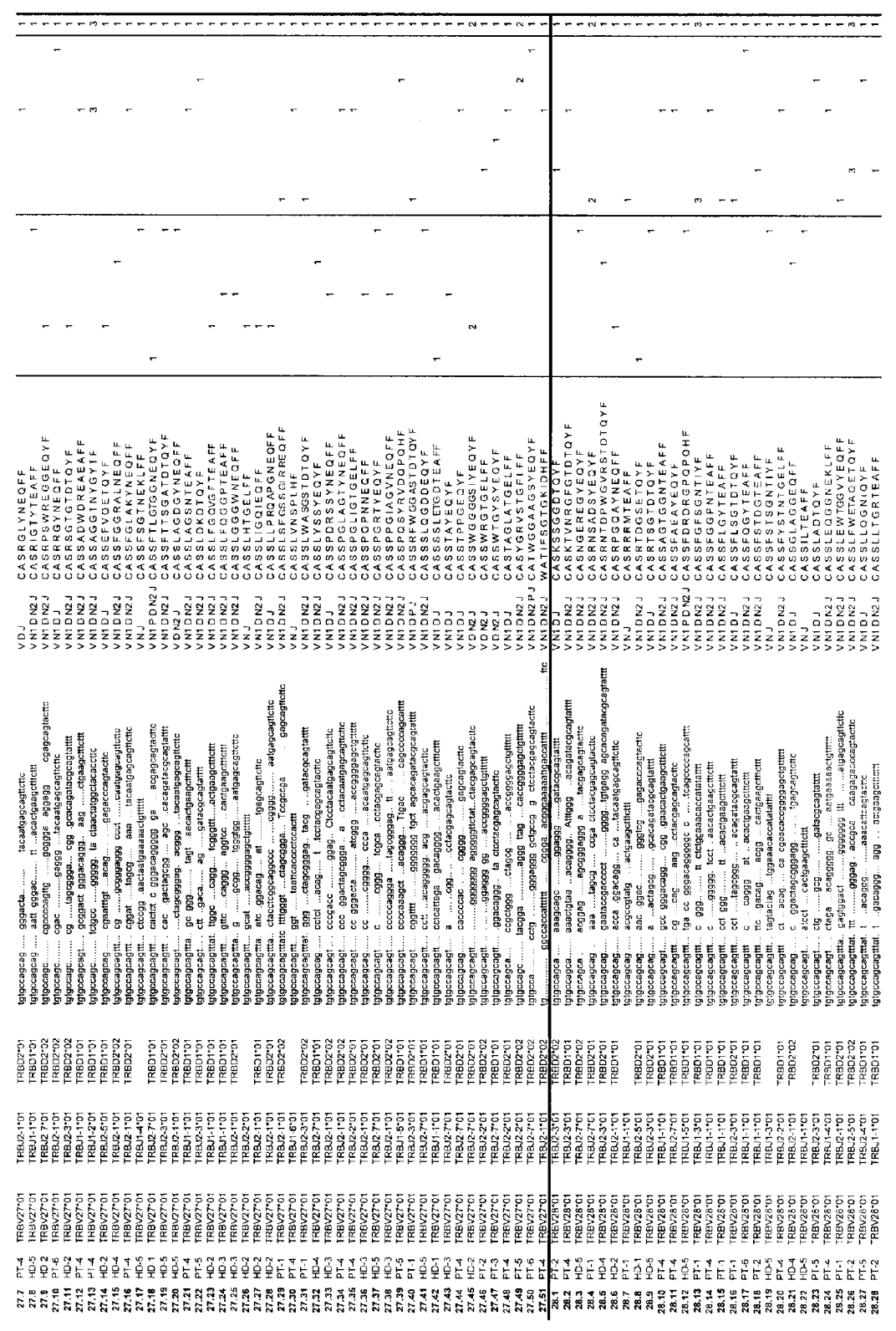

Figure 1-9:
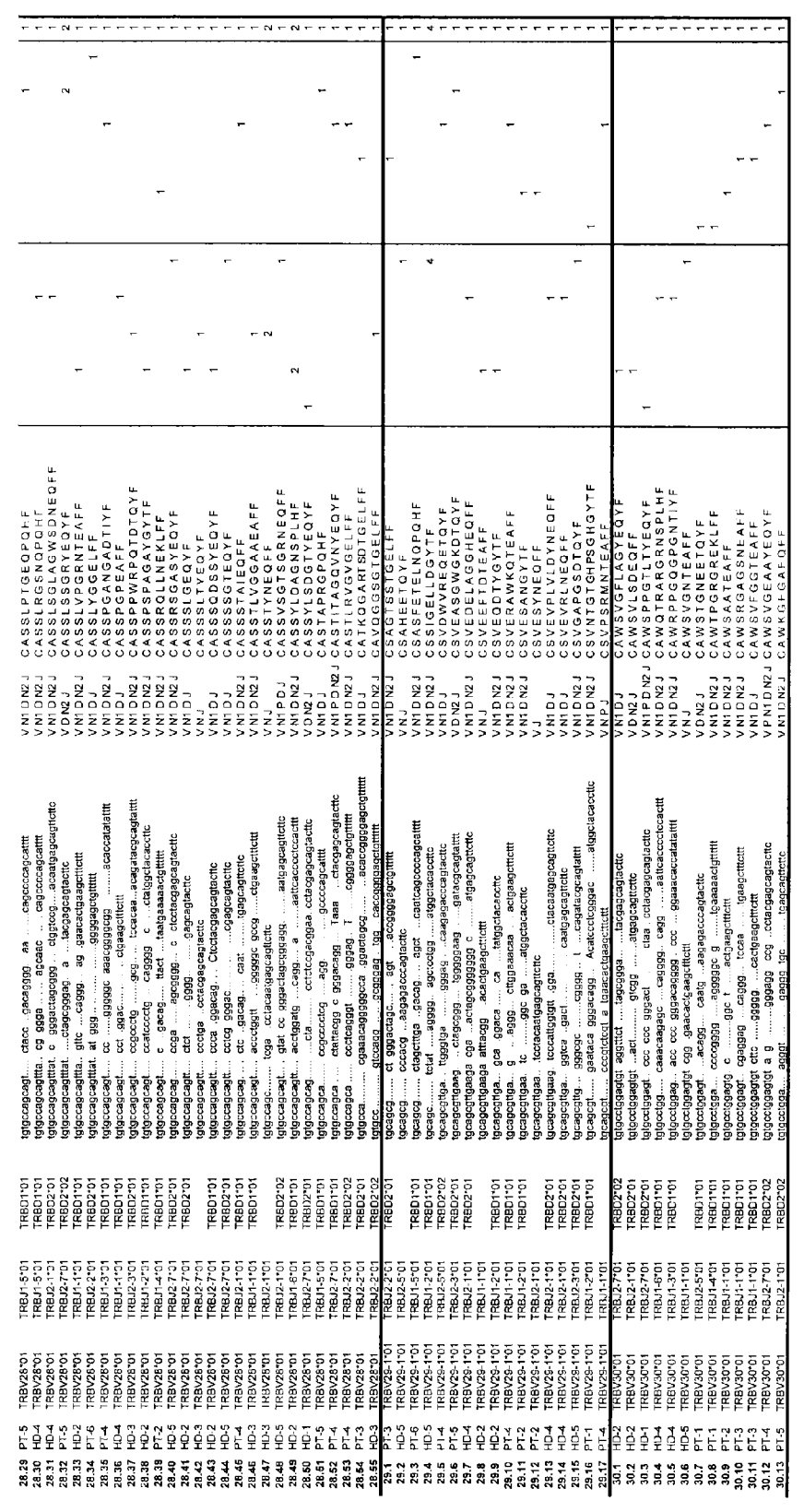

| | | | | | |
|---|---|---|---|---|---|
| HD-5 | 74 | TRBV19*01 | TRBJ2-2*01 | tgt gcc agt agt ata ccc tgg acc gag ctg ttt ttt | CASSIPWTGELFF |
| HD-5 | 3 | TRBV19*01 | TRBJ2-7*01 | tgt gcc agt agt atc act ttc tcc tac gag cag tac ttc | CASSITFSYEQYF |
| HD-5 | 51 | TRBV19*01 | TRBJ1-5*01 | tgt gcc agt agt aag ggt tat ggc aat cag ccc cag cat ttt | CASSKGYGNQPQHF |
| HD-5 | 4 | TRBV27*01 | TRBJ1-1*01 | tgt gcc agc agt cta gcg gga gac gga tac aat gag cag ttc ttc | CASSLAGDGYNEQFF |
| HD-5 | 32 | TRBV11-2*01 | TRBJ2-3*01 | tgt gcc agc agc ctt gat agc ggg agg gcc caa gat acg cag tat ttt | CASSLDSGRAQDTQYF |
| HD-5 | 66 | TRBV11-3*01 | TRBJ2-7*01 | tgt gcc agc agt tta gac agc tcc tac gag cag tac ttc | CASSLDSSYEQYF |
| HD-5 | 79 | TRBV7-3*01 | TRBJ2-7*01 | tgt gcc agc agc ttg ggc ggg agg gcc agc tcc tac gag cag tac ttc | CASSLGGRASSYEQYF |
| HD-5 | 101 | TRBV5-4*01 | TRBJ2-1*01 | tgt gcc agc agc ttg ggt gga ggt ccc ttc gat gag cag tac ttc | CASSLGSGGPFDEQFF |
| HD-5 | 85 | TRBV7-9*01 | TRBJ2-5*01 | tgt gcc agc agc ctg ggg tac ggc gaa gag acc cag tac ttc | CASSLGYGEETQYF |
| HD-5 | 110 | TRBV7-9*01 | TRBJ2-5*01 | tgt gcc agc agc ttg gga tac ggg gag gag acc cag tac ttc | CASSLGYGEGETQYF |
| HD-5 | 6 | TRBV7-9*01 | TRBJ2-3*01 | tgt gcc agc agc tta ggg tac ggg agc aca gat acg cag tat ttt | CASSLGYGSTDTQYF |
| HD-5 | 15 | TRBV7-9*01 | TRBJ2-3*01 | tgt gcc agc agc tta atc ccc gag ggc gtc ggc aca gat acg cag tat ttt | CASSLPEGVGTDTQYF |
| HD-5 | 62 | TRBV9*01 | TRBJ1-1*01 | tgt gcc agc agc ctc cgg ggg aac act gag gct ttc ttt | CASSLRGNTEAFF |
| HD-5 | 49 | TRBV5-4*01 | TRBJ2-7*01 | tgt gcc agc agc tta act agc ggg agt ctc agc gag cag tac ttc | CASSLTSGSLNEQYF |
| HD-5 | 47 | TRBV11-2*01 | TRBJ1-1*01 | tgt gcc agc agc tta gtc ccg aca ggg gag ggc tat ggc tac acc ttc | CASSLVPTGEDYGYTF |
| HD-5 | 99-1 | TRBV19*01 | TRBJ2-3*01 | tgt gcc agt aat atg gga ggg caa gat acg cag tat ttt | CASSMGGPDTQYF |
| HD-5 | 106 | TRBV12-3*01 | TRBJ1-1*01 | tgt gcc agc agt aac ggg caa gtt tgg aac act gaa gct ttc ttt | CASSNGQVWNTEAFF |
| HD-5 | 73 | TRBV18*01 | TRBJ2-7*01 | tgt gcc agc tca cct gca ggg cga acc tac tcc tac gag cag tac ttc ttc | CASSPAGRTYSYEQYF |
| HD-5 | 109 | TRBV27*01 | TRBJ2-7*01 | tgt gcc agc agc cct ggc cgt tac gag cag tac ttc | CASSPGRTYEQYF |
| HD-5 | 86 | TRBV7-2*02 | TRBJ1-1*01 | tgt gcc agc agc cca ggg act gaa gct ttc ttt | CASSPGSTEAFF |
| HD-5 | 50 | TRBV7-8*01 | TRBJ2-5*01 | tgt gcc agc agc cca cat agc ccc gga cta gcg gga gtt tca caa gag acc cag tac ttc | CASSPHSPGLAGVSQETQYF |
| HD-5 | 68 | TRBV18*01 | TRBJ2-1*01 | tgt gcc agc tca caa tgg ggg aca ggg gag tat gag cag ttc ttc | CASSPQWGTGEYEQFF |
| HD-5 | 65 | TRBV9*01 | TRBJ1-1*01 | tgt gcc agc agc ccc cgg aca gcc atg aac act gaa gct ttc ttt | CASSPRTAMNTEAFF |
| HD-5 | 14 | TRBV4-1*01 | TRBJ2-7*01 | tgt gcc agc agc caa gat tgg cca ggg agc tcc tac gag cag tac ttc | CASSQDWPGSSYEQYF |
| HD-5 | 1 | TRBV19*01 | TRBJ2-7*01 | tgc agc agc agc caa gag ggt ttt aat cag ccc cag cat ttt | CASSQEGFNQPQHF |
| HD-5 | 7 | TRBV3-1*01 | TRBJ1-5*01 | tgt gcc agc agc caa gaa ctt ccc ccc cct tac gag cag tac ttc | CASSQELSPPYEQYF |
| HD-5 | 104 | TRBV9*01 | TRBJ2-5*01 | tgt gcc agc agc cag ggg gcc gga gag acc cag tac ttc | CASSQGAEYQETQYF |
| HD-5 | 84 | TRBV4-1*01 | TRBJ2-2*01 | tgc agc agc agc cag ggg cag gga aga gag cag tac ttc | CASSQGGREQYF |
| HD-5 | 59-2 | TRBV3-1*01 | TRBJ2-7*01 | tgt gcc agc caa tta ggg gat ttt ggc tac acc ttc | CASSQLGDFGYTF |
| HD-5 | 75 | TRBV13*01 | TRBJ1-1*01 | tgt gcc agc agc caa cta cag cag ggc gac gag cag tac ttc | CASSQLQQGLTEAFF |
| HD-5 | 120 | TRBV7-6*01 | TRBJ2-3*01 | tgt gcc agc agc caa cgt aga aca gat acg cag tat ttt | CASSQRRTDTQYF |
| HD-5 | 60 | TRBV12-3*01 | TRBJ2-6*01 | tgt gcc agc agt cgg cag ggg gca gcg ccg gca aac gtc ctg act ttc | CASSRQGAAPANVLTF |
| HD-5 | 90 | TRBV28*01 | TRBJ2-7*01 | tgt gcc agc agc cga agc agg gcc tcc tac gag cag tac ttc | CASSRSGASYEQYF |
| HD-5 | 113 | TRBV7-6*01 | TRBJ2-1*01 | tgt gcc agc agc tcc ggc gat gag cag ttc ttc | CASSSGDEQFF |
| HD-5 | 57 | TRBV6-5*01 | TRBJ1-4*01 | tgt gcc agc agc tcc aaa ggg ccc cag gca tca aat gaa aaa ctg ttt ttt | CASSSKGPGASNEKLFF |
| HD-5 | 98 | TRBV27*01 | TRBJ2-7*01 | tgt gcc agc agt tcc tta cag cag gac gag gac gag cag tac ttc | CASSSLQGDDEQYF |
| HD-5 | 64 | TRBV5-6*01 | TRBJ2-7*01 | tgt gcc agc agt tcg cct ttc tca gga ctc gcg ggg acc tac tcc tac gag cag tac ttc | CASSSPFSGLAGTYSYEQYF |
| HD-5 | 112 | TRBV19*01 | TRBJ2-2*01 | tgt gcc agt agt tcc tcg gac agg gcg gta atc tgg acc ggg gag ctg ttt ttt | CASSSSDRAVIWTGELFF |
| HD-5 | 67 | TRBV28*01 | TRBJ2-7*01 | tgt gcc agc agt tcc tcg ggg acc gag cag tac ttc | CASSSSGTEQYF |
| HD-5 | 43 | TRBV9*01 | TRBJ2-4*01 | tgt gcc agc agc gta gac cca gct agg gac att cag tac ttc | CASSVDPARDIQYF |
| HD-5 | 58 | TRBV28*01 | TRBJ2-1*01 | tgt gcc agt agt gta tcc ggg act agc ggg agg aat gag cag tto ttc | CASSVSGTSGRNEQFF |
| HD-5 | 10 | TRBV6-5*01 | TRBJ2-5*01 | tgt gcc agc agc acc tct agg acc gta ggc tcc tac aat gag cag ttc ttc | CASSYSSGWQMDF |
| HD-5 | 70 | TRBV19*01 | TRBJ1-5*01 | tgt gcc agt acc gcg atc ggg cag tat ggc tac aat cag ccc cag cat ttt | CASTAIGGTGQYSNQPQHF |
| HD-5 | 18 | TRBV3-1*01 | TRBJ2-1*01 | tgt gcc agc agc acc cgc ggg ggt ggg ggt tcg gga gct ttc ttt | CASTRGGGGSEAFF |
| HD-5 | 42 | TRBV12-3*01 | TRBJ2-7*01 | tgt gcc agc agc aca tcc cgg acc gtc tcg agc tac aat gag cag tac ttc | CASTSRTVSSYNEQFF |
| HD-5 | 25 | TRBV24-1*01 | TRBJ1-5*01 | tgt gcc acc agt gat tac cgg gac agc acc aat gag cag ttc ttc | CATSDYRDSTYNEQFF |
| HD-5 | 33 | TRBV20-1*01 | TRBJ1-5*01 | tgc agt gct aca agt ttt agt agg gac aga ggc aat cag ccc cag cat ttt | CATSFSRDRGNQPQHF |
| HD-5 | 38 | TRBV15*01 | TRBJ2-2*01 | tgt gcc acc agt aga gac ggg agg ggc acg gga gct ttc ttt | CATSRDRGGTGELFF |
| HD-5 | 34 | TRBV12-3*01 | TRBJ2-3*01 | tgt gcc gta gcg cac aca gat acg cag tat ttt | CAVAHTDTQYF |
| HD-5 | 69 | TRBV30*01 | TRBJ1-1*01 | tgt tgg agt gtc ggg aac act gaa gct ttc ttt | CAWSVGNTEAFF |
| HD-5 | 71 | TRBV2*01 | TRBJ2-7*01 | tgt gac ctg aat gaa acg ttc cgc cgg ccc tac gag cag tac ttc | CDLNETFRRPYEQYF |
| HD-5 | 56-2 | TRBV20-1*01 | TRBJ2-1*01 | tgc agt gcc gac cac agg ggg gat gag cag ttc ttc | CSADHRGDEQFF |
| HD-5 | 29 | TRBV29-1*01 | TRBJ2-5*01 | tgc agc gcc cac gaa gag acc cag tac ttc | CSAHEETQYF |
| HD-5 | 2 | TRBV20-1*01 | TRBJ2-7*01 | tgc agt gct aac cgg gag cga gtc gag cag tac ttc | CSANREVEQYF |
| HD-5 | 39 | TRBV20-1*01 | TRBJ2-7*01 | tgc agt gct ccc tcg gga cag ggc tac gag cag tac ttc | CSAPSGQGYEQYF |
| HD-5 | 97 | TRBV20-1*01 | TRBJ1-1*01 | tgc agt gct aga gat agc ggg agc tcc tgg gat gag ttc ttt | CSARDSGSSWDEQFF |
| HD-5 | 5 | TRBV20-1*01 | TRBD2*02 TRBJ2-5*01 | tgc agt gga gat acg tgg gag aca gag acc cag tac ttc | CSGDTWEAGQETQYF |
| HD-5 | 11 | TRBV29-1*01 | TRBD1*01 TRBJ1-2*01 | tgc agc tct ata ggg gag ctc ctg gat ggc tac acc ttc | CSSIGELLDGYTF* |

Figure 2-7

| Sample | # | TRBV | TRBJ | TRBD | Nucleotide sequence | Amino acid |
|---|---|---|---|---|---|---|
| HD-5 | 12 | TRBV29-1*01 | TRBJ1-2*01 | TRBD1*01 | tgc agc tct ata ggg gag ctc ctg gat ggc tac acc ttc | CSSIGELLDGYTF* |
| HD-5 | 31 | TRBV29-1*01 | TRBJ1-2*01 | TRBD1*01 | tgc agc tct ata ggg gag ctc ctg gat ggc tac acc ttc | CSSIGELLDGYTF* |
| HD-5 | 105 | TRBV29-1*01 | TRBJ1-2*01 | TRBD1*01 | tgc agc tct ata gga gag ctc ctg gat ggc tac acc ttc | CSSIGELLDGYTF* |
| HD-5 | 115 | TRBV29-1*01 | TRBJ2-3*01 | TRBD2*01 | tgc agc gtt ggg gcg cgg ggg tca gac acg cag tat ttt | CSVGAPGSDTQYF |
| PT-1 | 3 | TRBV28*01 | TRBJ2-7*01 | TRBD2*01 | tgt gcc agc aga aat agc gcc gac tcc tac gag tac ttc | CASRNSADSYEQYF* |
| PT-1 | 61 | TRBV28*01 | TRBJ2-7*01 | TRBD2*01 | tgt gcc agc aga aat agc gcc gac tcc tac gag tac ttc | CASRNSADSYEQYF* |
| PT-1 | 15 | TRBV28*01 | TRBJ1-1*01 | | tgt gcc agc aga cgc cgt atg act gaa gct ttc ttt | CASRRMTEAFF |
| PT-1 | 44 | TRBV25-1*01 | TRBJ1-1*01 | TRBD1*01 | tgt gcc agc gag gag gag aca ggg agc agc gag act gaa gct ttc | CASSEETGGTSTEAFF |
| PT-1 | 38 | TRBV5-1*01 | TRBJ1-1*01 | TRBD2*01 | tgc gcc agc agc gag aga cag ggg aat atc tac tcc gag cag tac ttt | CASSERQGNYSEQYF |
| PT-1 | 18 | TRBV9*01 | TRBJ2-1*01 | TRBD2*01 | tgc gcc agc agt gag agt ggg gga gac tac aat gag cag ttc ttc | CASSESGGADYNEQFF |
| PT-1 | 6 | TRBV28*01 | TRBJ1-3*01 | TRBD1*01 | tgt gcc agc agt ttc ggg ttc tct gga aac acc ata tat ttt | CASSFGFSGNTIYF* |
| PT-1 | 8 | TRBV28*01 | TRBJ1-3*01 | TRBD1*01 | tgt gcc agc agt ttc tct gga aac acc ata tat ttt | CASSFGFSGNTIYF* |
| PT-1 | 23 | TRBV28*01 | TRBJ1-3*01 | TRBD2*01 | tgt gcc agc agt ttc ggg ttc tct gga aac acc ata tat ttt | CASSFGFSGNTIYF* |
| PT-1 | 49 | TRBV28*01 | TRBJ1-1*01 | TRBD1*01 | tgt gcc agc agt ttc ctg ggt tac act gaa gct ttc ttt | CASSFLGYTEAFF |
| PT-1 | 9 | TRBV28*01 | TRBJ2-3*01 | TRBD2*01 | tgt gcc agc agt ttc ctt agc gga aca gat acg cag tat ttt | CASSFLSGTDTQYF |
| PT-1 | 30 | TRBV7-9*01 | TRBJ2-2*01 | TRBD1*01 | tgt gcc agc agc ttc agg cag gga gca agc acc ggg gag ctg ttt ttt | CASSFRQGASTGELFF |
| PT-1 | 31 | TRBV19*01 | TRBJ2-5*01 | TRBD1*01 | tgt gcc agc agt agt ata caa ttg gtt cca gtg gag acc cag tac ttc | CASSIQLVPVETQYF |
| PT-1 | 37 | TRBV19*01 | TRBJ2-1*01 | TRBD2*01 | tgt gcc agc ttg gac ttg gac ggg gag cag ttc ttc | CASSLDVGEQFF |
| PT-1 | 35 | TRBV7-2*02 | TRBJ1-6*02 | TRBD1*01 | tgt gcc agc agc tta gaa ggt ggg cct gtt gtg ggt tca ccc ctc cac ttt | CASSLEGGPVVGSPLHF |
| PT-1 | 10 | TRBV5-5*01 | TRBJ2-3*01 | TRBD2*01 | tgt gcc agc agc ttg gaa cta gca ggg ggg gat acg cag tat ttt | CASSLELAGGRDTQYF |
| PT-1 | 12 | TRBV28*01 | TRBJ2-1*01 | TRBD2*01 | tgt gcc agc agt tta gag tgg act ggg ggg gtt tat gag cag ttc ttc | CASSLEWTGGVYEQFF |
| PT-1 | 14 | TRBV13*01 | TRBJ1-5*01 | TRBD1*01 | tgt gcc agc agc ttg ggc agg gga cta aat cag ccc cag cat ttt | CASSLGRGLNQPQHF |
| PT-1 | 32 | TRBV27*01 | TRBJ2-1*01 | TRBD2*02 | tgt gcc agc agt tta tct ttt ggg tct agc ggg atc cgc cga gag cag ttc ttc | CASSLSFGSSGIRREQFF |
| PT-1 | 28 | TRBV27*01 | TRBJ2-3*01 | TRBD2*02 | tgt gcc agc agt tta gct agc ggg agt acg gat acg cag tat ttt | CASSLWASGSTDTQYF |
| PT-1 | 20 | TRBV14*01 | TRBJ2-1*01 | TRBD1*01 | tgt gcc agc agc ccg gac agg ggc aat gag cag ttc ttc | CASSPDRGNEQFF |
| PT-1 | 29 | TRBV28*01 | TRBJ2-1*01 | TRBD2*02 | tgt gcc agc agc ccc agc ccc agt ccc gcc aat gag cag ttc ttc | CASSPSGSPANEQFF |
| PT-1 | 13 | TRBV9*01 | TRBJ2-1*01 | TRBD2*02 | tgt gcc agc agc ccc act ttt agc ggg agc aat gag cag ttc ttc | CASSPTFSGRNEQFF |
| PT-1 | 17 | TRBV4-1*01 | TRBJ2-1*01 | TRBD2*01 | tgc gcc agc agc caa gtt ttg agt agg ggt agc agg cag ttc ttc | CASSQVLSRGYGEQFF |
| PT-1 | 46 | TRBV27*01 | TRBJ2-3*01 | TRBD2*01 | tgt gcc agc agt cgg ttt tgg ggg ggt gct acc aca gat acg cag tat ttt | CASSRFWGGASTDTQYF |
| PT-1 | 2 | TRBV7-9*01 | TRBJ2-5*01 | TRBD1*01 | tgt gcc agc agc tca ggg cag gga gca cgt gaa acc cag tac ttc | CASSSGQGARETQYF |
| PT-1 | 36 | TRBV11-2*01 | TRBJ2-7*01 | TRBD2*02 | tgt gcc agc agc tcg aat gtg gga gga aat gag cag tac ttc | CASSSNVGENNEQFF |
| PT-1 | 21 | TRBV11-2*01 | TRBJ2-7*01 | TRBD1*01 | tgt gcc agc agt ccc agc ggg ggc acc tac gag cag tac ttc | CASSSPSGGTYEQYF |
| PT-1 | 26 | TRBV2*01 | TRBJ1-4*01 | TRBD1*01 | tgt gcc agc acg gga ctt cga gaa aaa ctg ttt ttt | CASSTGLREKLFF* |
| PT-1 | 42 | TRBV2*01 | TRBJ1-4*01 | TRBD1*01 | tgt gcc agc acg gga ctt cga gaa aaa ctg ttt ttt | CASSTGLREKLFF* |
| PT-1 | 1 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 4 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 7 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 11 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 16 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 19 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 24 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 25 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 27 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 39 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 40 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 41 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 43 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 48 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 50 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 51 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 52 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 53 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 54 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 55 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 58 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 59 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 60 | TRBV11-2*01 | TRBJ2-3*01 | TRBD2*01 | tgt gcc agc agt tgg ggg gga gat tct agc aca gat acg cag tat ttt | CASSWGGDSSTDTQYF* * * |
| PT-1 | 34 | TRBV5-1*01 | TRBJ1-1*01 | TRBD1*01 | tgc gcc agc agt tat aca gac tcg aac act gaa gct ttc ttt | CASSYTDSNTEAFF |

Figure 2-8:
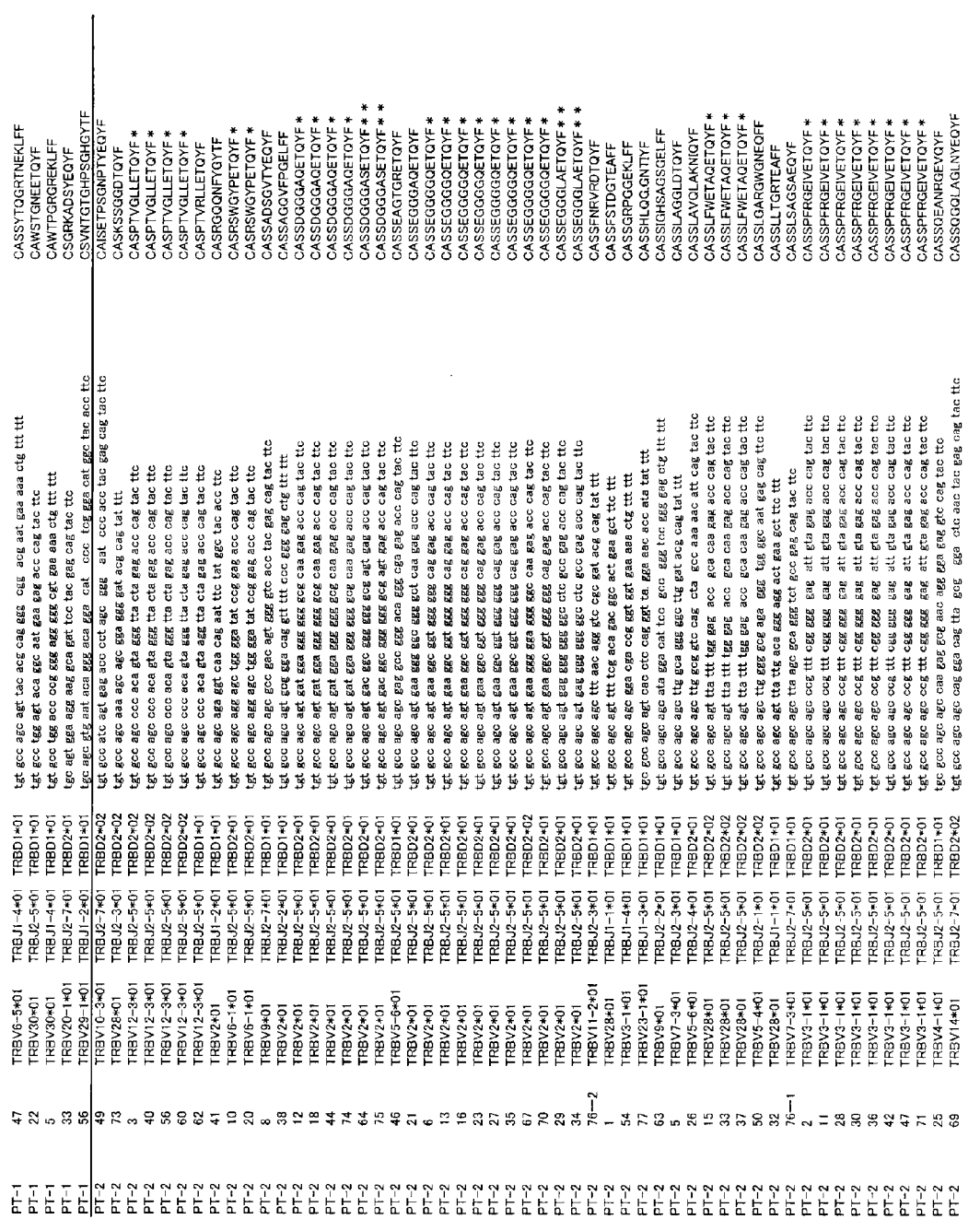

Figure 2-9:
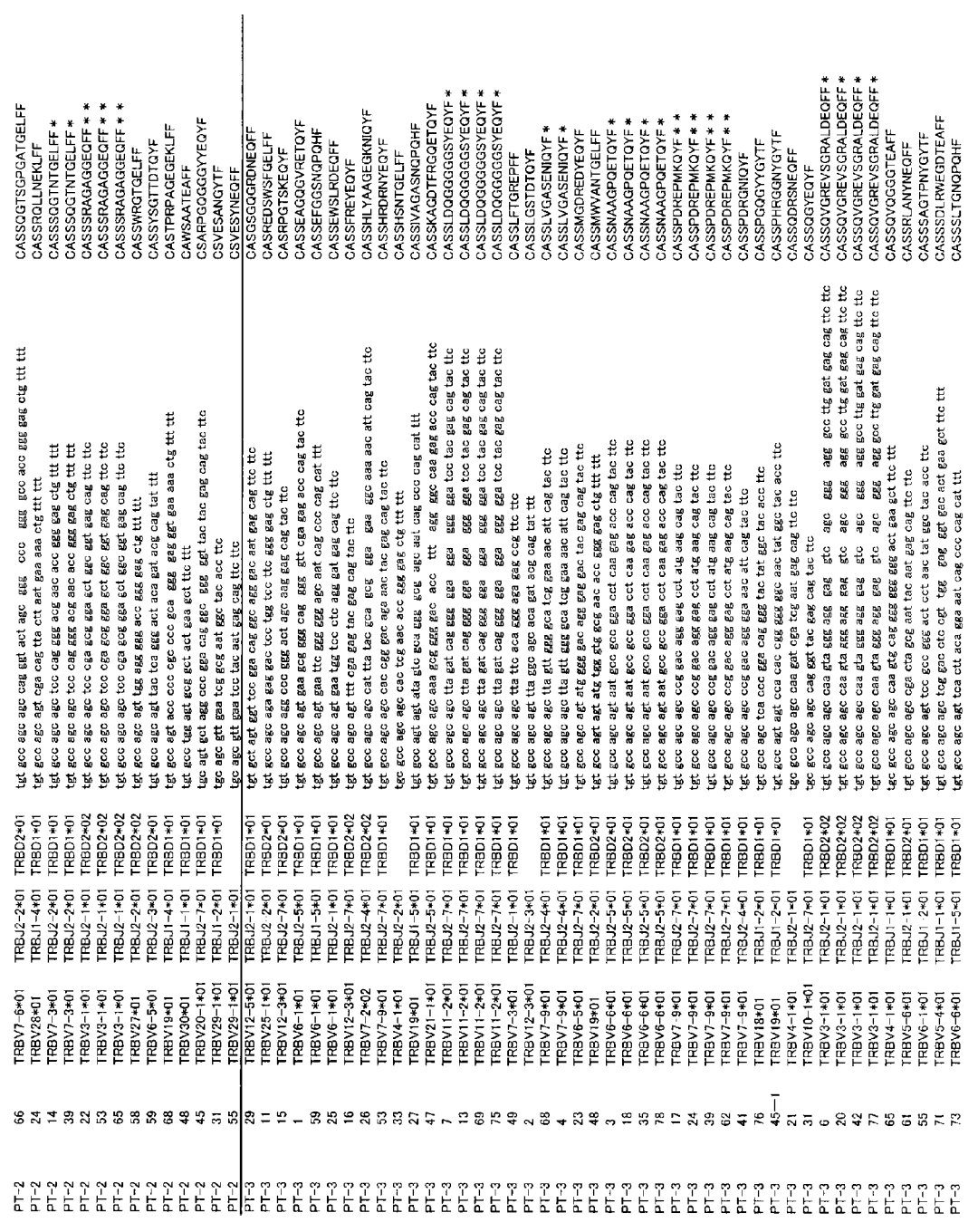

| | | | | | | |
|---|---|---|---|---|---|---|
| PT-3 | 12 | TRBV6-5*01 | TRBJ2-7*01 | TRBD1*01 | tgt gcc agc agt tgc ccc ggg aca ggg tac gag tac ttc | CASSSPGTGEYEQYF |
| PT-3 | 34 | TRBV18*01 | TRBJ2-1*01 | TRBD1*01 | tgt gcc agc tca tct tac ggg aca ggg ggc gat gag cag ttc ttc | CASSSYGTGGDEQFF * |
| PT-3 | 46 | TRBV18*01 | TRBJ2-1*01 | TRBD1*01 | tgt gcc agc tca tct tac ggg aca ggg ggc gat gag cag ttc ttc | CASSSYGTGGDEQFF * |
| PT-3 | 58 | TRBV6-1*01 | TRBJ1-4*01 | TRBD1*01 | tgt gcc agc agt aca ggg gcg acc ggg act aat gaa aaa ctg ttt ttt | CASSTGATGTNEKLFF |
| PT-3 | 38 | TRBV9*01 | TRBJ2-3*01 | | tgt gcc agc agc gta gtt ccg aac aca gat acg cag tat ttt | CASSVVPNTDTQYF |
| PT-3 | 8 | TRBV11-3*01 | TRBJ2-1*01 | TRBD2*02 | tgt gcc agc agc tgg ggg tgg gag agc ggg agg gcg ttc gat gag cag ttc ttc | CASSWGWESGRAFDEQFF |
| PT-3 | 28 | TRBV27*01 | TRBJ2-7*01 | TRBD1*01 | tgt gcc agc agt tgg aca ggg tac tcc tac gag cag tac ttc | CASSWTGYSYEQYF |
| PT-3 | 52 | TRBV6-5*01 | TRBJ1-1*01 | TRBD1*01 | tgt gcc agc tat ggg gaa acc gct ttc ttt | CASSYGETAFF |
| PT-3 | 36 | TRBV25-1*01 | TRBJ1-3*01 | TRBD1*01 | tgt gcc agc aca gcg ggg gac acc ata tat ttt | CASTAGDTIYF * |
| PT-3 | 50 | TRBV25-1*01 | TRBJ1-3*01 | TRBD1*01 | tgt gcc agc aca gcg ggg gac acc ata tat ttt | CASTAGDTIYF * |
| PT-3 | 70 | TRBV28*01 | TRBJ2-2*01 | TRBD2*01 | tgt gcc acg aaa cag gga gcc agg act agc gac acc ggg gag ctg ttt ttt | CATKQGARTSDTGELFF |
| PT-3 | 64-1 | TRBV15*01 | TRBJ2-7*01 | TRBD2*01 | tgt gcc aca caa gtc ggg ggc tcc tac gag cag tac ttc | CATQVGGGSYEQYF |
| PT-3 | 66 | TRBV15*01 | TRBJ2-7*01 | TRBD2*02 | tgt gcc acc agc aga ggc cta ggg gga gcc tac gag cag tac ttc | CATSRGLAGAYEQYF |
| PT-3 | 45-2 | TRBV24-1*01 | TRBJ1-1*01 | TRBD1*01 | tgt gcc acc gtg ttg ggg aac act gaa gct ttc ttt | CATVLGNTEAFF |
| PT-3 | 9 | TRBV30*01 | TRBJ1-1*01 | TRBD1*01 | tgt gcc tgg agt cga gga gca ggg tcc aat gaa gct ttc ttt | CAWSRGAGSNEAFF |
| PT-3 | 51 | TRBV30*01 | TRBJ1-1*01 | TRBD1*01 | tgt gcc tgg agt gcc ttc cgg aac gaa gct ttc ttt | CAWSVFGGTEAFF |
| PT-3 | 67 | TRBV29-1*01 | TRBJ2-2*01 | TRBD2*01 | tgc agc gct ggg act agc agt acc ggg gag ctg ttt ttt | CSAGTSSTGELFF |
| PT-3 | 32 | TRBV20-1*01 | TRBJ2-1*01 | TRBD2*02 | tgc agt gct aga gga gca gcc ggg agg ggc cat gag cag ttc ttc | CSARGAGRGHEQFF * |
| PT-3 | 57 | TRBV20-1*01 | TRBJ2-1*01 | TRBD2*02 | tgc agt gct aga gga gcc gga agg ggc cat gag cag ttc ttc | CSARGAGRGHEQFF * |
| PT-3 | 60 | TRBV20-1*01 | TRBJ2-1*01 | TRBD2*02 | tgc agt gct aga gga gcc gga agg ggc cat gag cag ttc ttc | CSARGAGRGHEQFF * |
| PT-3 | 74 | TRBV20-1*01 | TRBJ2-1*01 | TRBD2*02 | tgc agt gct aga gga gcc gga agg ggc cat gag cag ttc ttc | CSARGAGRGHEQFF * |
| PT-3 | 56 | TRBV20-1*01 | TRBJ2-1*01 | TRBD2*01 | tgc agt gct aga ggg ccc ttg cgg ttc tat gag cag ttc ttc | CSARGPLRFYEQFF |
| PT-4 | 52 | TRBV10-3*01 | TRBJ2-5*01 | TRBD2*01 | tgt gcc atc agt gag tcg ggc ggt ggg tca gag acc cag tac ttc | CAISESGGGSETQYF |
| PT-4 | 10 | TRBV12-5*01 | TRBJ2-1*01 | TRBD2*02 | tgt agt ggt ttg tcc agg act agc ggg act atg tcc tac aat gag cag ttc ttc | CASGLSRTSGTMSYNEQFF |
| PT-4 | 52 | TRBV9*01 | TRBJ2-1*01 | TRBD1*01 | tgt gcc agc aac ccc agg ggc cag ggg gac acc ggg gag ctg ttt ttt | CASGNPKGQGQTGELFF |
| PT-4 | 37-1 | TRBV28*01 | TRBJ2-3*01 | TRBD1*01 | tgc agc agc aaa act gta aac agg ggg ttt ggg aca gat acg cag tat ttt | CASKTVNRGFGTDTQYF |
| PT-4 | 16 | TRBV2*01 | TRBJ2-1*01 | TRBD2*01 | tgt gcc agc agc caa aac cta tac aat gag cag ttc ttc | CASQNLAGPQYNEQFF |
| PT-4 | 44 | TRBV27*01 | TRBJ2-7*01 | TRBD2*01 | tgt gcc agc aga cta tac aat gag cag ttc ttc | CASRGLYNEQFF |
| PT-4 | 25 | TRBV25-1*01 | TRBJ2-3*01 | TRBD1*01 | tgt gcc tcc cgt cca ggc aca gat acg cag tat ttt | CASRPGTDTQYF |
| PT-4 | 39 | TRBV27*01 | TRBJ1-1*01 | TRBD2*01 | tgt gcc agc agt gcg gac tgg gac agg gaa gct gaa gct ttc ttt | CASSADWDREAEAFF |
| PT-4 | 21 | TRBV9*01 | TRBJ2-3*01 | TRBD1*01 | tgt gcc agc agc ggg gac cca gat acg cag tat ttt | CASSAGDPDTQYF |
| PT-4 | 49 | TRBV27*01 | TRBJ1-2*01 | TRBD1*01 | tgt gcc agc tct gcc ggg ggt act aac tat ggc tac acc ttc | CASSAGGTNYGYTF * |
| PT-4 | 51 | TRBV27*01 | TRBJ1-2*01 | TRBD1*01 | tgt gcc agc tct gcc ggg ggt act aac tat ggc tac acc ttc | CASSAGGTNYGYTF * |
| PT-4 | 29 | TRBV27*01 | TRBJ1-2*01 | TRBD1*01 | tgt gcc agc agt gcg ggt act aac tat ggc tac acc ttc | CASSAGGTNYGYTF * |
| PT-4 | 62 | TRBV28*01 | TRBJ1-1*01 | TRBD2*01 | tgt gcc agc agt gga aca gat acg cag tat ttt | CASSAGTGGNTEAFF |
| PT-4 | 20 | TRBV9*01 | TRBJ2-7*01 | TRBD1*01 | tgt gcc agc agt gcc tcc tcc agg act acg gag cag tac ttc | CASSASSGTTYEQYF |
| PT-4 | 42 | TRBV2*01 | TRBJ1-5*01 | TRBD2*01 | tgt gcc agc agt gaa tgg caa ggg aat ca ccc ctc cac ttc | CASSEWQGNSPLHF |
| PT-4 | 31 | TRBV28*01 | TRBJ2-7*01 | TRBD1*01 | tgt gcc agc agt ttc gca gaa gcc tac gag cag tac ttc | CASSFAEAYEQYF |
| PT-4 | 31 | TRBV12-4*01 | TRBJ2-7*01 | TRBD1*01 | tgt gcc agc agt ttc gag aca ggt aga tac gag cag tac ttc | CASSFETGRYEQYF |
| PT-4 | 26 | TRBV28*01 | TRBJ1-4*01 | TRBD1*01 | tgt gcc agc agt ttc ggg ggc cct aat gaa aca ctg ttt ttt | CASSFGGPNTEAFF |
| PT-4 | 32 | TRBV27*01 | TRBJ2-1*01 | TRBD2*01 | tgt gcc agc agt ttc gga tta gcg aaa tac aat gag cag ttc ttc | CASSFGLAKYNEQFF |
| PT-4 | 35 | TRBV6-2*01 | TRBJ2-7*01 | TRBD2*01 | tgt gcc agc agt ttc agc gtc gcc tac gag cag tac ttc | CASSFSVAYEQYF |
| PT-4 | 8 | TRBV28*01 | TRBJ1-1*01 | TRBD1*01 | tgt gcc agc agt ttc tac agc acg aac acc ggg gag ctg ttt ttt | CASSFYSTNTGELFF |
| PT-4 | 12 | TRBV4-2*01 | TRBJ2-7*01 | TRBD2*02 | tgt gcc agc agc cac gag cgg aac acc ggg gag ctg ttt ttt | CASSHERERNTGELFF |
| PT-4 | 14 | TRBV6-5*01 | TRBJ2-3*01 | TRBD1*01 | tgt gcc agc agt cac agg gcc acc agg cag tat ttt | CASSHRAADTQYF |
| PT-4 | 22 | TRBV27*01 | TRBJ1-1*01 | TRBD2*02 | tgt gcc agc agt tta gcg ggt agt aac act gaa gct ttc ttt | CASSLAGSNTEAFF |
| PT-4 | 66 | TRBV5-4*01 | TRBJ2-1*01 | TRBD1*01 | tgt gcc agc agt ttg gaa cta gcg gga gac gag tac ttc | CASSLELAGDEGYF |
| PT-4 | 54 | TRBV28*01 | TRBJ1-4*01 | TRBD1*01 | tgt gcc agc agt cta gaa cag ggg ggc aat gaa aaa ctg ttt ttt | CASSLEQGGNEKLFF |
| PT-4 | 44 | TRBV11-2*01 | TRBJ2-5*01 | TRBD2*02 | tgt gcc agc agc ttg gaa tct gtg aac caa gag acc cag tac ttc | CASSLESVNQETQYF |
| PT-4 | 13 | TRBV6-2*01 | TRBJ2-2*01 | TRBD2*02 | tgt gcc agc agt ttg gag acg ctg aac acc ggg gag ctg ttt ttt | CASSLETLNTGELFF |
| PT-4 | 38 | TRBV7-2*01 | TRBJ2-1*01 | TRBD1*01 | tgt gcc agc agc tta gag gct ggc acc ggg gag ctg ttt ttt | CASSLGAGTGELFF |
| PT-4 | 57 | TRBV6-5*01 | TRBJ1-2*01 | TRBD1*01 | tgt gcc agc agt ttg ggg gct ccc tac gag cag tac ttc | CASSLGAPYEQYF |
| PT-4 | 3 | TRBV7-9*01 | TRBJ2-3*01 | TRBD1*01 | tgt gcc agc agc tta ggg aca gat acg cag tat ttt | CASSLGTDTQYF |
| PT-4 | 40 | TRBV7-6*01 | TRBJ2-3*01 | TRBD2*01 | tgt gcc agc agc ttg ggg act gga aca gat acg cag tat ttt | CASSLGTGTDTQYF |
| PT-4 | 63 | TRBV7-3*01 | TRBJ2-1*01 | TRBD2*01 | tgt gcc agc agc ttg ggg act agc gga gat gag cag ttc ttc | CASSLGTSDEQFF |
| PT-4 | 36-1 | TRBV7-2*01 | TRBJ2-7*01 | TRBD2*01 | tgt gcc agc agc tta gac ggg ggt tcc tac aat gag cag ttc ttc | CASSLLDGGSYNEQFF |
| PT-4 | 68 | TRBV7-2*02 | TRBJ2-7*01 | TRBD2*01 | tgt gcc agc agc ctt ccg ggg agt agt tac gag cag tac ttc | CASSLPGGSSYEQYF |
| PT-4 | 25 | TRBV7-2*01 | TRBJ2-1*01 | TRBD2*02 | tgt gcc agc agc tta cag cag gct tgg tac gag cag ttc ttc | CASSLQGGWYEQYF |
| PT-4 | | TRBV7-2*01 | TRBJ2-1*01 | TRBD2*02 | tgt gcc agc agc tta agg ccc aat gag cag ttc ttc | CASSLRPNEQFF |

Figure 2-11:
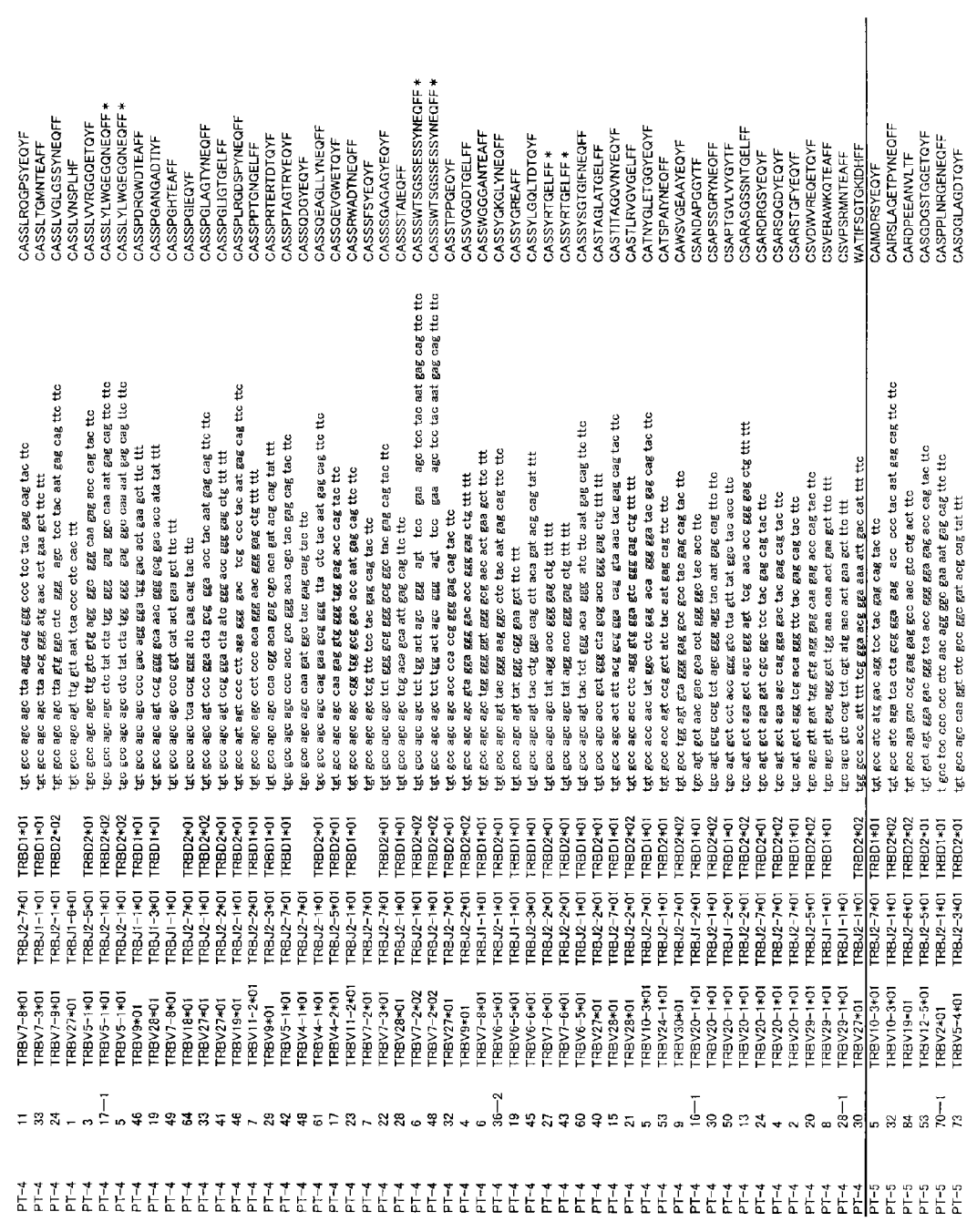

Figure 2-12:
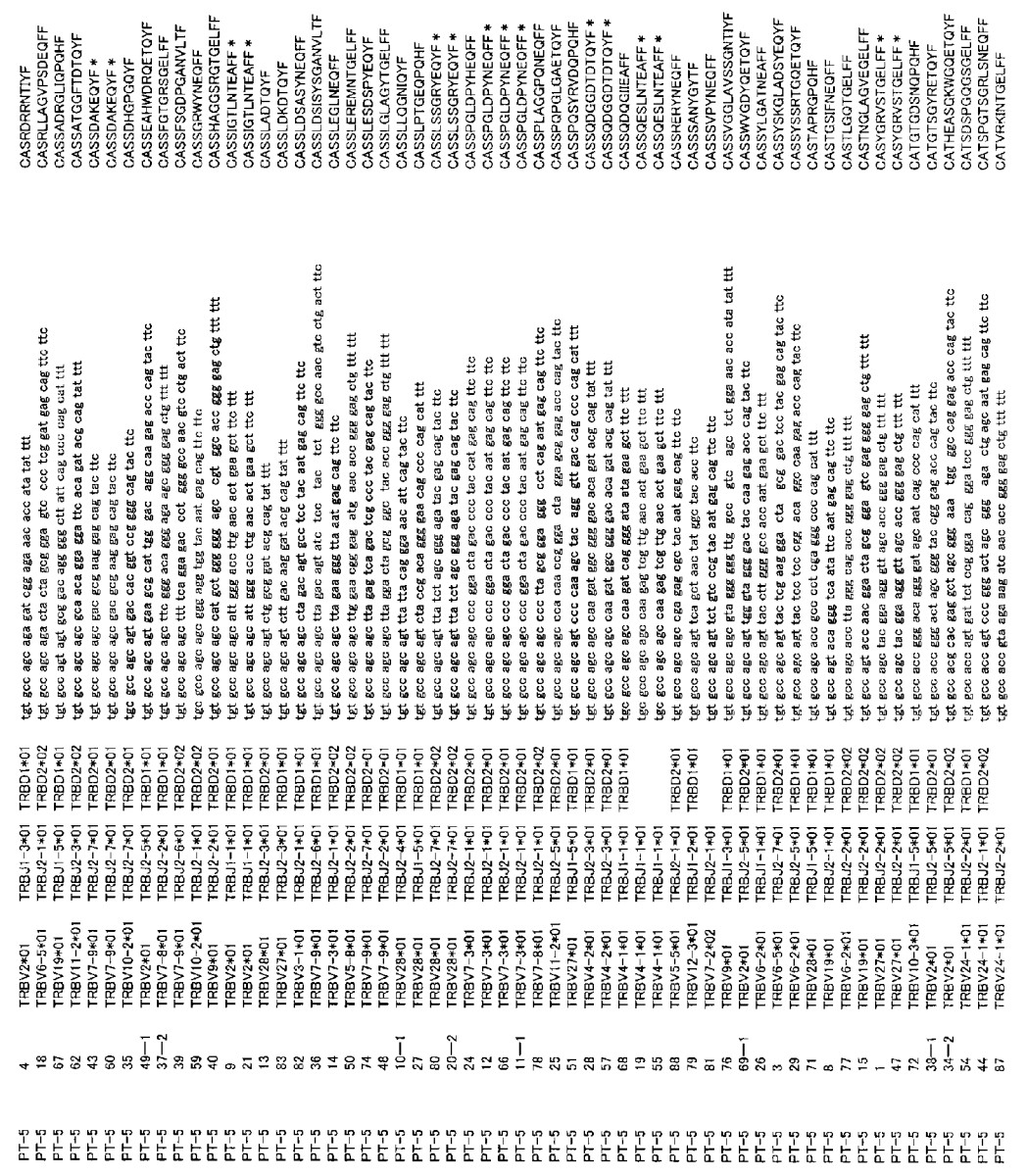

| | | | | | | |
|---|---|---|---|---|---|---|
| PT-5 | 86 | TRBV30-01 | TRBJ2-1*01 | TRBD2*02 | tgt gcc tgg aag ggt gag ggt gct gag cag ttc | CAWKGEGAEQFF |
| PT-5 | 22 | TRBV20-1*01 | TRBJ2-7*01 | TRBD2*01 | tgc agt gct aga agt ggg act agc gca ccc tac gag cag tac ttc | CSARSGTSAPYEQYF* |
| PT-5 | 75 | TRBV20-1*01 | TRBJ2-7*01 | TRBD2*01 | tgc agt gct aga agt ggg act agc gca ccc tac gag cag tac ttc | CSARSGTSAPYEQYF* |
| PT-5 | 17 | TRBV20-1*01 | TRBJ1-1*01 | TRBD1*01 | tgc agt gct aga act ggg ggg gct gaa gct ttt | CSARTGGAEAFF* * |
| PT-5 | 23 | TRBV20-1*01 | TRBJ1-1*01 | TRBD1*01 | tgc agt gct aga act ggg ggg gct gaa gct ttc ttt | CSARTGGAEAFF* * |
| PT-5 | 52 | TRBV20-1*01 | TRBJ1-1*01 | TRBD1*01 | tgc agt gct aga act ggg ggg gct gaa gct ttt | CSARTGGAEAFF* * |
| PT-5 | 65 | TRBV20-1*01 | TRBJ1-6*01 | TRBD1*01 | tgc agt gct agc ccc ggg aca gat aat tca ccc ctc cac ttt | CSASPGTDNSPLHF |
| PT-5 | 42 | TRBV20-1*01 | TRBJ2-7*01 | TRBD2*01 | tgc agt gct agc cgc cct cgc ccg ggt ggc gga tcc tac gag cag tac ttc | CSASRPPGGGSYEQYF |
| PT-5 | 93 | TRBV29-1*01 | TRBJ2-3*01 | TRBD2*01 | tgc agc gtt gaa gct agc ggg tgg gga aag gat acg cag tat ttt | CSVEASGWGKDTQYF |
| PT-6 | 19 | TRBV6-1*01 | TRBJ2-4*01 | TRBD2*01 | tgt gcc agc tgt gac ggg act aga agt gac att cag tac ttc | CASCDGTRESDIQYF |
| PT-6 | 14 | TRBV6-1*01 | TRBJ1-1*01 | TRBD1*01 | tgt gcc agt gga ggg ttt gag aaa tat ggc tac acc ttc | CASGGFEKYGYTF |
| PT-6 | 31-1 | TRBV27-01 | TRBJ2-1*01 | TRBD2*02 | tgt gcc agc cga ggg tac aat gag cag ttc ttc | CASRRQYNEQFF |
| PT-6 | 7 | TRBV6-1*01 | TRBJ1-5*01 | TRBD1*01 | tgc agc agc agt gaa gcg gcc gaa tcc aat cag ccc cag cat ttt | CASSEAAESNQPQHF |
| PT-6 | 12 | TRBV6-1*01 | TRBJ2-3*01 | TRBD2*01 | tgc agc agc agt gaa gga gcg ggg ggg ctt gat acg cag tat ttt | CASSEGAGGLDTQYF |
| PT-6 | 26 | TRBV2*01 | TRBJ2-3*01 | TRBD1*01 | tgt gcc agc agt gaa aca ggg tct agc aca gat acg cag tat ttt | CASSETGSSTDTQYF |
| PT-6 | 4 | TRBV2*01 | TRBJ2-2*01 | TRBD1*01 | tgc agc agc agt gaa tgg aca ggg gat acg gag ctg ttt ttt | CASSEWTGDTGELFF* |
| PT-6 | 27 | TRBV2*01 | TRBJ2-2*01 | TRBD1*01 | tgc agc agc agt gaa tgg aca ggg gat acc ggg gag ctg ttt ttt | CASSEWTGDTGELFF* |
| PT-6 | 9 | TRBV28-01 | TRBJ1-1*01 | TRBD1*01 | tgc agc agc agt ttc cag gga tac act gaa gct ttc ttt | CASSFQGYTEAFF |
| PT-6 | 11 | TRBV12-3*01 | TRBJ1-6*02 | TRBD1*01 | tgt gcc agc agt ttt tgg ggc ccc gac gat tca ccc ctc cac ttt | CASSFWGPDDSPLHF |
| PT-6 | 3 | TRBV10-1*01 | TRBJ2-1*01 | TRBD2*02 | tgc gcc agc agt ggc ggt agc ggg agt aca ttt ccc aat gag cag ttc ttc | CASSGGSGSTFPNEQFF |
| PT-6 | 10 | TRBV19*01 | TRBJ1-2*01 | TRBD1*01 | tgt gcc agt agt ata gac gcg gac agg gga ttg ggc tac acc ttc | CASSIDADRGLGGYTF |
| PT-6 | 25 | TRBV19*01 | TRBJ2-1*01 | TRBD1*01 | tgc agc agc agt atc gta caa acc aat gag cag ttc ttc | CASSIVQTNEQFF |
| PT-6 | 5 | TRBV19*01 | TRBJ1-1*01 | TRBD1*01 | tgc agc agt agt tta ggg aca gga gag atg aac act gaa gct ttc ttt | CASSLGTGEMNTEAFF |
| PT-6 | 11 | TRBV2*01 | TRBJ1-1*01 | TRBD2*02 | tgt gcc agc agc ctc gta gga gag gtg tca ctc ttc | CASSLVGEVSLF |
| PT-6 | 1 | TRBV28*01 | TRBJ2-1*01 | TRBD2*01 | tgc agc agt tta tat ggg ggg ctg ttt ttt | CASSLYGGELFF |
| PT-6 | 10 | TRBV25-1*01 | TRBJ2-2*01 | TRBD1*01 | tgt gcc agc agt ccc gga cag ttc gac acc ggg gag ctg ttt ttt | CASSPGQFDTGELFF |
| PT-6 | 41 | TRBV4-3*01 | TRBJ2-7*01 | TRBD2*01 | tgc agc agc agt caa gat tta act ggg ggg gat ggg cag ttc ttc | CASSQDLTSGDEQFF |
| PT-6 | 24 | TRBV4-3*01 | TRBJ1-1*01 | TRBD1*01 | tgc gcc agc agc caa gat agg agg ggg gtg tgg tgg act gaa gct ttc ttt | CASSQDRRGVGWTEAFF |
| PT-6 | 28 | TRBV14*01 | TRBJ2-7*01 | | tgt gcc agc agc caa gat tac gta atg gac gag cag tac ttc | CASSQDYMDEQYF |
| PT-6 | 3 | TRBV12-3*01 | TRBJ1-2*01 | TRBD1*01 | tgt gcc agc agt tca gcg aac tat ggc tac acc ttc | CASSSANYGYTF |
| PT-6 | 8 | TRBV28*01 | TRBJ2-1*01 | TRBD1*01 | tgt gcc agc agt tgg ggc gct gac aat gag cag ttc ttc | CASSWGADNEQFF |
| PT-6 | 13 | TRBV6-2*01 | TRBJ2-7*01 | TRBD2*01 | tgc agc agc agt tac ggg cta gcg gcc tcc tac gag cag tac ttc | CASSYGLAGSYEQYF |
| PT-6 | 16 | TRBV6-2*01 | TRBJ2-3*01 | TRBD1*01 | tgc agc agc agt tac tcg tcg gac agg gta tca gat acg cag tat ttt | CASSYSSDRVSDTQYF* |
| PT-6 | 19 | TRBV6-2*01 | TRBJ2-3*01 | TRBD1*01 | tgc agc agc agt tac tcg tcg gac agg gta tca gat acg cag tat ttt | CASSYSSDRVSDTQYF* |
| PT-6 | 15 | TRBV6-2*01 | TRBJ2-3*01 | TRBD1*01 | tgc agc agc agt tac tcg tcg gac agg gta tca gat acg cag tat ttt | CASSYSSDRVSDTQYF* |
| PT-6 | 23 | TRBV6-2*01 | TRBJ2-7*01 | TRBD1*01 | tgc agc agc agt tac tcg aca aac tcc tac gag cag tac ttc | CASSYSTNSYEQYF |
| PT-6 | 30 | TRBV6-2*01 | TRBJ2-7*01 | TRBD1*01 | tgc agc agc agt tac tcg act agc tac gag cag tac ttc | CASSYSTSAYEQYF |
| PT-6 | 34 | TRBV19*01 | TRBJ2-1*01 | TRBD2*02 | tgc agt acg gcg gga gcc ttt acc tac aat gag cag ttc ttc | CASTAGAFTYNEQFF |
| PT-6 | 43 | TRBV6-2*01 | TRBJ2-7*01 | TRBD1*01 | tgc agc agc acc gct cag gga caa atc atc tcc tac gag cag tac ttc | CASTAQGQIISYEQYF |
| PT-6 | 1 | TRBV15*01 | TRBJ2-3*01 | TRBD2*01 | tgc agc acc agc aga gat atg cta aca gat acg cag tat ttt | CATSRDMLTDTQYF* |
| PT-6 | 38 | TRBV15*01 | TRBJ2-3*01 | TRBD2*01 | tgc agc acc agc aga gat atg cta aca gat acg cag tat ttt | CATSRDMLTDTQYF* |
| PT-6 | 15 | TRBV15-01 | TRBJ1-3*01 | TRBD1*01 | tgt agc acc agc tca att cct ggg gaa gcc ata tat ttt | CATSSIPGEAYF* * |
| PT-6 | 36 | TRBV15-01 | TRBJ1-3*01 | TRBD1*01 | tgt agc acc agc tca att cct ggg gaa gcc ata tat ttt | CATSSIPGEAYF* * |
| PT-6 | 28 | TRBV15*01 | TRBJ1-3*01 | TRBD1*01 | tgt agc acc agc tca att cct ggg gaa gcc ata tat ttt | CATSSIPGEAYF* * |
| PT-6 | 27 | TRBV15*01 | TRBJ2-5*01 | TRBD1*01 | tgt agc acc agt aca caa gga cag ggc tac gag cag tac ttc | CATSTGQGYEQYF |
| PT-6 | 2 | TRBV27*01 | TRBJ2-7*01 | TRBD2*02 | tgt gcc acc tgg gga ggg gct ggc gcc tcc tac gag cag tac ttc | CATWGGAAGSYEQYF |
| PT-6 | 21 | TRBV20-1*01 | TRBJ1-6*02 | TRBD1*01 | tgc agt gcc gga cag gga gaa agc tca ccc ctc cac ttt | CSAGGQESSPLHF |
| PT-6 | 42 | TRBV20-1*01 | TRBJ2-1*01 | TRBD1*01 | tgc agt gcc ccg gga cag ccg tac aat gag cag ttc ttc | CSAPGQPYNEQFF |
| PT-6 | 30 | TRBV20-1*01 | TRBJ2-1*01 | TRBD2*01 | tgc agt gct caa gga ctg tat cct aat gag cag ttc ttc | CSAQGLYPNEQFF |
| PT-6 | 16 | TRBV20-1*01 | TRBJ2-7*01 | TRBD1*01 | tgt agt gct aga gag gag gat tac gag cag tac ttc | CSAREDYEQYF |
| PT-6 | 17 | TRBV29-1*01 | TRBJ2-5*01 | TRBD2*01 | tgc agt gct aga gga gac gga gag acc cag tac ttc | CSARGDEETQYF |
| PT-6 | 5 | TRBV20-1*01 | TRBJ1-5*01 | TRBD1*01 | tgc agc gct agc ttt gag aca gag ctc aat cag ccc cag cat ttt | CSASFETELNQPQHF |
| PT-6 | 7 | TRBV29-1*01 | TRBJ2-1*01 | TRBD2*01 | tgc agt gct agc tct cta gcg ggc aat gag cag ttc ttc | CSASSLAGNEQFF* |
| PT-6 | 39 | TRBV20-1*01 | TRBJ2-1*01 | TRBD2*01 | tgc agt gct agc tct cta gcg ggc aat gag cag ttc ttc | CSASSLAGNEQFF* |
| PT-6 | 32 | TRBV20-1*01 | TRBJ2-1*01 | TRBD2*01 | tgc agt gct agc tct cta gcg ggc aat gag cag ttc ttc | CSASSLAGNEQFF* |

RECEPTOR GENE FOR PEPTIDE CANCER ANTIGEN-SPECIFIC T CELL

TECHNICAL FIELD

The present invention relates to a polynucleotide contained in the gene for a cancer antigen-specific T-cell receptor, and the peptide encoded by the polynucleotide, and to cancer tests, e.g., diagnosis, prognosis, or treatment monitoring using the same, cancer therapy, and the like.

BACKGROUND ART

Cancer treatments include extirpation of cancer by surgical operation, radiotherapy, treatment with anti-cancer medication, and immunotherapy. Among these treatments, immunotherapy in particular has drawn attention in recent years because it is a treatment more selective and specific against cancer with least side effects. Inter alia, attempts have been extensively made to treat cancer and leukemia by targeting WT1 protein, which is abundantly present in many types of cancer cells and leukemia cells. In order to study the mechanism of the WT1-targeted anti-cancer therapy and to further increase the effect of the therapy, it is necessary to identify the nucleotide sequences of the T-cell receptor (TCR) genes of WT1-specific cytotoxic T-cells (CTL) and the amino acid sequences of the receptor peptides encoded by the nucleotide sequences. However, up to the present date, there is little information about the sequences of those receptor genes and the receptor peptides, and uses thereof although a number of researches have been conducted (see, e.g., patent document 1 and non-patent documents 1-5).

PRIOR ART DOCUMENTS

Patent Documents

Patent Document 1: WO 2008/108257 A1

Non Patent Documents

Non Patent Document 1: Valmori D. et al., J. Immunol. 168: 4231-4240, 2002
Non Patent Document 2: Dietrich P Y. et al., Cancer Res. 61: 2047-2054, 2001
Non Patent Document 3: Coulie P G. et al., Proc. Natl. Acad. Sci. U.S.A. 98: 10290-10295, 2001
Non Patent Document 4: Godelaine D. et al. J. Immunol. 171: 4893-4897, 2003
Non Patent Document 5: Mandruzzato S. et al., J. Immunol. 169: 4017-4024, 2002

SUMMARY OF THE INVENTION

Problems to be Solved by the Invention

An object of the present invention has been to reveal the amino acid sequences of T-cell receptors (TCRs) of WT1-specific cytotoxic T-cells (CTLs) for WT1 protein, and the nucleotide sequences of the genes encoding them, in particular, the amino acid and nucleotide sequences of the CDR3 region of them, as well as to use those pieces of information in cancer tests (diagnosis, prognosis, treatment monitoring, or the like) and in cancer therapy.

Means for Solving the Problems

To accomplish the above object, the inventors have conducted extensive research and determined, for the first time, the nucleotide and amino acid sequences of CDR3 of the Vβ chain of T-cell receptors (TCRs) of WT1-specific cytotoxic T-cells (CTLs) from healthy individuals and HLA-A*0201-positive patients, and has thereby completed the present invention. In particular, the inventors have identified, for the first time, the base sequences of genes for T-cell receptors (TCRs) of WT1-specific cytotoxic T-cells recognizing WT1 cancer antigen peptide (126th-134th amino acids of WT1 protein; RMFPNAPYL (SEQ ID No.: 1543)).

Thus, the present invention provides the following:

(1) A polynucleotide having a nucleotide sequence encoding CDR3 of a Vβ chain of a T-cell receptor (TCR) of a WT1-specific cytotoxic T-cell (CTL), wherein said polynucleotide has DNA having any of the CDR3 nucleotide sequences shown in SEQ ID Nos.: 1-756, RNA complementary to the DNA, or a complementary sequence thereof;

(2) The polynucleotide according to (1), wherein said polynucleotide consists of a DNA consisting of any of the CDR3 nucleotide sequences shown in SEQ ID Nos.: 1-756, or an RNA complementary thereto, or a complementary sequence thereof;

(3) A peptide having an amino acid sequence of CDR3 of a Vβ chain of a T-cell receptor (TCR) of a WT1-specific cytotoxic T-cell (CTL), wherein said peptide has any of the amino acid sequences of CDR3 shown in SEQ ID Nos.: 757-1512;

(4) The peptide according to (3) consisting of any of the amino acid sequences of CDR3 shown in SEQ ID Nos.: 757-1512;

(5) Use of the polynucleotide of (1) or (2), or the peptide of (3) or (4) as a cancer marker;

(6) A method for diagnosing cancer in an HLA-A*0201-positive patient, which comprises assessing the clonality of a WT1-specific CTL having any of the polynucleotides of (1) or (2), or any of the peptides of (3) or (4) in a sample obtained from the patient before therapy, wherein in case that a WT1-specific CTL having a multiplicity of clonality is present, a higher possibility of developing cancer in the patient before therapy is determined when the types of a WT1-specific CTL with a multiplicity of clonality are more abundant, or when the clonality of a WT1-specific CTL with a multiplicity of clonality is higher;

(7) The method according to (6), wherein a higher possibility of developing cancer in the patient before therapy is determined when the clonality of a WT1-specific CTL having any of the CDR3 polynucleotides or any of the CDR3 peptides and having the clonality of 3 or more is higher, or when the types of a WT1-specific CTL having the clonality of 3 or more are more abundant;

(8) A method for testing for sensitivity of an HLA-A*0201-positive patient to WT1 peptide immunotherapy, which comprises assessing the number of types and the clonality of WT1-specific CTLs having any of the polynucleotides of (1) or (2) or any of the peptides of (3) or (4) in a sample obtained from the patient before therapy, wherein the patient is determined to have sensitivity to WT1 peptide immunotherapy when the types of WT1-specific CTLs with a multiplicity of clonality are more abundant in the patient than in a subject non-responsive to the immunotherapy;

(9) The method according to (8), wherein a patient is determined to have higher sensitivity to WT1 peptide immunotherapy when the types of WT1-specific CTL clones with a multiplicity of clonality are more abundant, or the clonality is larger in the patient before therapy;

(10) A method for monitoring WT1 peptide immunotherapy in an HLA-A*2402-positive patient, which comprises assessing the clonality of WT1-specific CTL clones having any of the polynucleotides of (1) or (2) or any of the peptides of (3) or (4) in a sample obtained from the patient before and after the immunotherapy, wherein the patient is determined to have responded to WT1 peptide immunotherapy when the clonality of any of the WT1-specific CTL clones increases after the immunotherapy compared to before the immunotherapy;
(11) The method according to (10), wherein a patient is determined to have higher responsiveness to WT1 peptide immunotherapy when the larger becomes the increase rate in the clonality, or the more abundant become the types of clones with increased clonality after the WT1 peptide immunotherapy;
(12) An antibody against the peptide of (3) or (4);
(13) A chip comprising the polynucleotide of (1) or (2), the peptide of (3) or (4), or the antibody of (12);
(14) A primer for amplifying a CDR3 polypeptide, which has a sequence selected from the sequences shown in SEQ ID Nos.: 1513-1538;
(15) A kit for diagnosing cancer, a kit for testing for sensitivity of a patient to WT1 peptide immunotherapy, or a kit for monitoring WT1 peptide immunotherapy, comprising means for detecting a WT1-specific CTL having the polynucleotide of (1) or (2) or the peptide of (3) or (4);
(16) A device for cancer diagnosis, a device for testing for sensitivity of a patient to WT1 peptide immunotherapy, or a device for monitoring WT1 peptide immunotherapy, comprising means for detecting a WT1-specific CTL having the polynucleotide of (1) or (2) or the peptide of (3) or (4);
(17) The kit according to (15), comprising the chip of (13) or the primer of (14);
(18) The device according to (16), wherein the chip of (13) or the primer of (14) is used in the device;
(19) A lymphocyte of an HLA-A*0201-positive cancer patient, into which a T-cell receptor gene comprising a sequence of the polynucleotide of (1) or (2) is introduced.

The present invention also provides cancer therapy using lymphocytes from HLA-A*0201-positive patients, wherein a T-cell receptor gene containing a CDR3 polynucleotide is introduced into the lymphocytes.

Further, the present invention provides an antibody raised against a CDR3 polypeptide and use thereof.

Effect of the Invention

By virtue of the present invention, the nucleotide sequences contained in the gene for the Vβ chain of T-cell receptors (TCRs) of WT1-specific cytotoxic T-cells (CTLs), and the amino acid sequences of peptides encoded by them, in particular, the nucleotide and amino acid sequences of CDR3 have been revealed, and extensive cancer tests (diagnosis, prognosis, treatment monitoring, or the like), effective cancer therapies, and the like are enabled using these polynucleotides and peptides.

BRIEF DESCRIPTION OF DRAWINGS

FIG. 1-1 shows the nucleotide and amino acid sequences of CDR3 of the Vβ chain of T-cell receptors (TCRs), the number of clone (clonality) thereof and the like of WT1-specific cytotoxic T-cells (CTLs) from healthy individuals and HLA-A*0201-positive solid cancer patients, which sequences have been identified in the present invention (DNA disclosed as SEQ ID NOS: 1-68 and peptides disclosed as SEQ ID NOS: 757-824, respectively, in order of appearance). In the figure, "clone #" indicates the clone numbers, the numbers to the left of the dot indicate the family numbers of Vβ chains, and the numbers to the right of the dot indicate the reference numbers. The column "name" indicates the subjects from which the clone derived, HD1, HD2, HD3, HD4, and HD5 indicate healthy individuals, respectively, and PT1, PT2, PT3, PT4, PT5 and PT6 indicate solid cancer patients and indicate the patients with glioblastoma, primitive neuroectodermal tumor, glioblastoma, ovarian cancer, cecal cancer, and glioblastoma, respectively. V name, J name, and D name indicate the details of the V region, J region, and D region, respectively. The nucleotide sequences are indicated by portion which derives from V region, N1 region, D region, (P)N2 region, or J region. The column to the right of the nucleotide sequence indicates what kind of region the sequence which constitutes the nucleotide sequence was derived from. The amino acid sequence encoded by each nucleotide sequence is indicated by 1 letter code known to those skilled in the art. Two columns to the right of the amino acid sequence indicate clonality in each healthy individual and clonality in each cancer patient. The rightmost column indicates the total of clonality of each clone.

FIG. 1-2 shows the nucleotide and amino acid sequences of CDR3 of the Vβ chain of T-cell receptors (TCRs), the number of clone (clonality) thereof and the like of WT1-specific cytotoxic T-cells (CTLs) from healthy individuals and HLA-A*0201-positive solid cancer patients, which sequences have been identified in the present invention (DNA disclosed as SEQ ID NOS: 69-141 and peptides disclosed as SEQ ID NOS: 825-897, respectively, in order of appearance). In the figure, "clone #" indicates the clone numbers, the numbers to the left of the dot indicate the family numbers of Vβ chains, and the numbers to the right of the dot indicate the reference numbers. The column "name" indicates the subjects from which the clone derived, HD1, HD2, HD3, HD4, and HD5 indicate healthy individuals, respectively, and PT1, PT2, PT3, PT4, PT5 and PT6 indicate solid cancer patients and indicate the patients with glioblastoma, primitive neuroectodermal tumor, glioblastoma, ovarian cancer, cecal cancer, and glioblastoma, respectively. V name, J name, and D name indicate the details of the V region, J region, and D region, respectively. The nucleotide sequences are indicated by portion which derives from V region, N1 region, D region, (P)N2 region, or J region. The column to the right of the nucleotide sequence indicates what kind of region the sequence which constitutes the nucleotide sequence was derived from. The amino acid sequence encoded by each nucleotide sequence is indicated by 1 letter code known to those skilled in the art. Two columns to the right of the amino acid sequence indicate clonality in each healthy individual and clonality in each cancer patient. The rightmost column indicates the total of clonality of each clone.

FIG. 1-3 shows the nucleotide and amino acid sequences of CDR3 of the Vβ chain of T-cell receptors (TCRs), the number of clone (clonality) thereof and the like of WT1-specific cytotoxic T-cells (CTLs) from healthy individuals and HLA-A*0201-positive solid cancer patients, which sequences have been identified in the present invention (DNA disclosed as SEQ ID NOS: 142-214 and peptides disclosed as SEQ ID NOS: 898-970, respectively, in order of appearance). In the figure, "clone #" indicates the clone numbers, the numbers to the left of the dot indicate the family numbers of Vβ chains, and the numbers to the right of the dot indicate the reference numbers. The column "name" indicates the subjects from which the clone derived, HD1, HD2, HD3, HD4, and HD5 indicate healthy individuals, respectively, and PT1, PT2, PT3, PT4, PT5 and PT6 indicate solid cancer patients and indicate the patients with glioblastoma, primitive neuroectodermal tumor, glioblastoma, ovarian cancer, cecal cancer, and glioblastoma, respectively. V name, J name, and D name indicate the details of the V region, J region, and D region, respectively. The nucleotide sequences are indicated by portion which derives from V region, N1 region, D region, (P)N2 region, or J region. The column to the right of the nucleotide sequence indicates what kind of region the sequence which constitutes the nucleotide sequence was derived from. The amino acid sequence encoded by each nucleotide sequence is indicated by 1 letter code known to those skilled in the art. Two columns to the right of the amino acid sequence indicate clonality in each healthy individual and clonality in each cancer patient. The rightmost column indicates the total of clonality of each clone.

FIG. 1-4 shows the nucleotide and amino acid sequences of CDR3 of the Vβ chain of T-cell receptors (TCRs), the number of clone (clonality) thereof and the like of WT1-specific cytotoxic T-cells (CTLs) from healthy individuals and HLA-A*0201-positive solid cancer patients, which sequences have been identified in the present invention (DNA disclosed as SEQ ID NOS: 215-287 and peptides disclosed as SEQ ID NOS: 971-1043, respectively, in order of appearance). In the figure, "clone #" indicates the clone numbers, the numbers to the left of the dot indicate the family numbers of Vβ chains, and the numbers to the right of the dot indicate the reference numbers. The column "name" indicates the subjects from which the clone derived, HD1, HD2, HD3, HD4, and HD5 indicate healthy individuals, respectively, and PT1, PT2, PT3, PT4, PT5 and PT6 indicate solid cancer patients and indicate the patients with glioblastoma, primitive neuroectodermal tumor, glioblastoma, ovarian cancer, cecal cancer, and glioblastoma, respectively. V name, J name, and D name indicate the details of the V region, J region, and D region, respectively. The nucleotide sequences are indicated by portion which derives from V region, N1 region, D region, (P)N2 region, or J region. The column to the right of the nucleotide sequence indicates what kind of region the sequence which constitutes the nucleotide sequence was derived from. The amino acid sequence encoded by each nucleotide sequence is indicated by 1 letter code known to those skilled in the art. Two columns to the right of the amino acid sequence indicate clonality in each healthy individual and clonality in each cancer patient. The rightmost column indicates the total of clonality of each clone.

FIG. 1-5 shows the nucleotide and amino acid sequences of CDR3 of the Vβ chain of T-cell receptors (TCRs), the number of clone (clonality) thereof and the like of WT1-specific cytotoxic T-cells (CTLs) from healthy individuals and HLA-A*0201-positive solid cancer patients, which sequences have been identified in the present invention (DNA disclosed as SEQ ID NOS: 288-360 and peptides disclosed as SEQ ID NOS: 1044-1116, respectively, in order of appearance). In the figure, "clone #" indicates the clone numbers, the numbers to the left of the dot indicate the family numbers of Vβ chains, and the numbers to the right of the dot indicate the reference numbers. The column "name" indicates the subjects from which the clone derived, HD1, HD2, HD3, HD4, and HD5 indicate healthy individuals, respectively, and PT1, PT2, PT3, PT4, PT5 and PT6 indicate solid cancer patients and indicate the patients with glioblastoma, primitive neuroectodermal tumor, glioblastoma, ovarian cancer, cecal cancer, and glioblastoma, respectively. V name, J name, and D name indicate the details of the V region, J region, and D region, respectively. The nucleotide sequences are indicated by portion which derives from V region, N1 region, D region, (P)N2 region, or J region. The column to the right of the nucleotide sequence indicates what kind of region the sequence which constitutes the nucleotide sequence was derived from. The amino acid sequence encoded by each nucleotide sequence is indicated by 1 letter code known to those skilled in the art. Two columns to the right of the amino acid sequence indicate clonality in each healthy individual and clonality in each cancer patient. The rightmost column indicates the total of clonality of each clone.

FIG. 1-6 shows the nucleotide and amino acid sequences of CDR3 of the Vβ chain of T-cell receptors (TCRs), the number of clone (clonality) thereof and the like of WT1-specific cytotoxic T-cells (CTLs) from healthy individuals and HLA-A*0201-positive solid cancer patients, which sequences have been identified in the present invention (DNA disclosed as SEQ ID NOS: 361-433 and peptides disclosed as SEQ ID NOS: 1117-1189, respectively, in order of appearance). In the figure, "clone #" indicates the clone numbers, the numbers to the left of the dot indicate the family numbers of Vβ chains, and the numbers to the right of the dot indicate the reference numbers. The column "name" indicates the subjects from which the clone derived, HD1, HD2, HD3, HD4, and HD5 indicate healthy individuals, respectively, and PT1, PT2, PT3, PT4, PT5 and PT6 indicate solid cancer patients and indicate the patients with glioblastoma, primitive neuroectodermal tumor, glioblastoma, ovarian cancer, cecal cancer, and glioblastoma, respectively. V name, J name, and D name indicate the details of the V region, J region, and D region, respectively. The nucleotide sequences are indicated by portion which derives from V region, N1 region, D region, (P)N2 region, or J region. The column to the right of the nucleotide sequence indicates what kind of region the sequence which constitutes the nucleotide sequence was derived from. The amino acid sequence encoded by each nucleotide sequence is indicated by 1 letter code known to those skilled in the art. Two columns to the right of the amino acid sequence indicate clonality in each healthy individual and clonality in each cancer patient. The rightmost column indicates the total of clonality of each clone.

FIG. 1-7 shows the nucleotide and amino acid sequences of CDR3 of the Vβ chain of T-cell receptors (TCRs), the number of clone (clonality) thereof and the like of WT1-specific cytotoxic T-cells (CTLs) from healthy individuals and HLA-A*0201-positive solid cancer patients, which sequences have been identified in the present invention (DNA disclosed as SEQ ID NOS: 434-506 and peptides disclosed as SEQ ID NOS: 1190-1262, respectively, in order of appearance). In the figure, "clone #" indicates the clone numbers, the numbers to the left of the dot indicate the family numbers of Vβ chains, and the numbers to the right of the dot indicate the reference numbers. The column "name" indicates the subjects from which the clone derived, HD1, HD2, HD3, HD4, and HD5 indicate healthy individuals, respectively, and PT1, PT2, PT3, PT4, PT5 and PT6 indicate solid cancer patients and indicate the patients with glioblastoma, primitive neuroectodermal tumor, glioblastoma, ovarian cancer, cecal cancer, and glioblastoma, respectively. V name, J name, and D name indicate the details of the V region, J region, and D region, respectively. The nucleotide sequences are indicated by portion which derives from V region, N1 region, D region, (P)N2 region, or J region. The column to the right of the nucleotide sequence indicates what kind of region the sequence which constitutes the nucleotide sequence was derived from. The amino acid sequence encoded by each nucleotide sequence is indicated by 1 letter code known to those skilled in the art. Two columns to the right of the amino acid sequence indicate clonality in each healthy individual and clonality in each cancer patient. The rightmost column indicates the total of clonality of each clone.

FIG. 1-8 shows the nucleotide and amino acid sequences of CDR3 of the Vβ chain of T-cell receptors (TCRs), the number of clone (clonality) thereof and the like of WT1-specific cytotoxic T-cells (CTLs) from healthy individuals and HLA-A*0201-positive solid cancer patients, which sequences have been identified in the present invention (DNA disclosed as SEQ ID NOS: 507-579 and peptides disclosed as SEQ ID NOS: 1263-1335, respectively, in order of appearance). In the figure, "clone #" indicates the clone numbers, the numbers to the left of the dot indicate the family numbers of Vβ chains, and the numbers to the right of the dot indicate the reference numbers. The column "name" indicates the subjects from which the clone derived, HD1, HD2, HD3, HD4, and HD5 indicate healthy individuals, respectively, and PT1, PT2, PT3, PT4, PT5 and PT6 indicate solid cancer patients and indicate the patients with glioblastoma, primitive neuroectodermal tumor, glioblastoma, ovarian cancer, cecal cancer, and glioblastoma, respectively. V name, J name, and D name indicate the details of the V region, J region, and D region, respectively. The nucleotide sequences are indicated by portion which derives from V region, N1 region, D region, (P)N2 region, or J region. The column to the right of the nucleotide sequence indicates what kind of region the sequence which constitutes the nucleotide sequence was derived from. The amino acid sequence encoded by each nucleotide sequence is indicated by 1 letter code known to those skilled in the art. Two columns to the right of the amino acid sequence indicate clonality in each healthy individual and clonality in each cancer patient. The rightmost column indicates the total of clonality of each clone.

FIG. 1-9 shows the nucleotide and amino acid sequences of CDR3 of the Vβ chain of T-cell receptors (TCRs), the number of clone (clonality) thereof and the like of WT1-specific cytotoxic T-cells (CTLs) from healthy individuals and HLA-A*0201-positive solid cancer patients, which sequences have been identified in the present invention (DNA disclosed as SEQ ID NOS: 580-636 and peptides disclosed as SEQ ID NOS: 1336-1392, respectively, in order of appearance). In the figure, "clone #" indicates the clone numbers, the numbers to the left of the dot indicate the family numbers of Vβ chains, and the numbers to the right of the dot indicate the reference numbers. The column "name" indicates the subjects from which the clone derived, HD1, HD2, HD3, HD4, and HD5 indicate healthy individuals, respectively, and PT1, PT2, PT3, PT4, PT5 and PT6 indicate solid cancer patients and indicate the patients with glioblastoma, primitive neuroectodermal tumor, glioblastoma, ovarian cancer, cecal cancer, and glioblastoma, respectively. V name, J name, and D name indicate the details of the V region, J region, and D region, respectively. The nucleotide sequences are indicated by portion which derives from V region, N1 region, D region, (P)N2 region, or J region. The column to the right of the nucleotide sequence indicates what kind of region the sequence which constitutes the nucleotide sequence was derived from. The amino acid sequence encoded by each nucleotide sequence is indicated by 1 letter code known to those skilled in the art. Two columns to the right of the amino acid sequence indicate clonality in each healthy individual and clonality in each cancer patient. The rightmost column indicates the total of clonality of each clone.

FIG. 2-1 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 1545-1601 and peptides disclosed as SEQ ID NOS: 2295-2351, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-2 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 1602-1659 and peptides disclosed as SEQ ID NOS: 2352-2409, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-3 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 1660-1717 and peptides disclosed as SEQ ID NOS: 2410-2467, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-4 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 1718-1775 and peptides disclosed as SEQ ID NOS: 2468-2525, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-5 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 1776-1833 and peptides disclosed as SEQ ID NOS: 2526-2583, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-6 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 1834-1891 and peptides disclosed as SEQ ID NOS: 2584-2641, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-7 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 1892-1949 and peptides disclosed as SEQ ID NOS: 2642-2699, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-8 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 1950-2007 and peptides disclosed as SEQ ID NOS: 2700-2757, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-9 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 2008-2065 and peptides disclosed as SEQ ID NOS: 2758-2815, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-10 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 2066-2123 and peptides disclosed as SEQ ID NOS: 2816-2873, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-11 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 2124-2181 and peptides disclosed as SEQ ID NOS: 2874-2931, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-12 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 2182-2239 and peptides disclosed as SEQ ID NOS: 2932-2989, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

FIG. 2-13 summarizes the nucleotide and amino acid sequences of CDR3 of the Vβ chain of T-cell receptors (TCRs) of the WT1-specific cytotoxic T-cells (CTLs) obtained from healthy individuals and HLA-A*0201-positive solid cancer patients (DNA disclosed as SEQ ID NOS: 2240-2294 and peptides disclosed as SEQ ID NOS: 2990-3044, respectively, in order of appearance). In the figure, the leftmost column "name" indicates a healthy individual or a cancer patient and the meaning of each symbol is the same as that of FIG. 1. "Cell #" indicates the numbers of cells obtained from each individual. TRBV, TRBJ and TRBD have the same meaning as that of V name, J name, and D name of FIG. 1, respectively. In the indication of the nucleotide sequence, the dots are omitted (which are not omitted in FIG. 1). "*" or "**" to the right of the amino acid sequence indicates that two or more of the same sequences are arranged.

MODE FOR CARRYING OUT THE INVENTION

The inventors have stained the peripheral lymphocytes from cancer patients with WT1 tetramer that consists of WT1 peptide/HLA-A*0201 complexes, and has separated WT1 tetramer-positive cells one by one using a FACS; cDNAs have been generated from each separated cell, and the nucleotide sequences encoding CDR3 contained in the Vβ chain of T-cell receptors (hereinafter may be referred to as "TCR") of WT1-specific cytotoxic T-cells, hereinafter may be referred to as "WT1-specific CTL", have been determined by applying PCR method (FIGS. 1-1 to 1-9 and FIGS. 2-1 to 2-13; SEQ ID Nos.: 1-756). From these results, the amino acid sequences of the CDR3 have been also determined (FIGS. 1-1 to 1-9 and FIGS. 2-1 to 2-13; SEQ ID Nos.: 757-1512). These sequences have been determined for the first time in the present invention.

Thus, in one aspect, the present invention provides a polynucleotide having the nucleotide sequence encoding CDR3 of the Vβ chain of T-cell receptors (TCRs) of WT1-specific cytotoxic T-cells (CTLs) obtained from healthy individuals and HLA-A*0201-positive patients, wherein the polynucleotide has DNA having any of the CDR3 nucleotide sequences shown in SEQ ID Nos.: 1-756, RNA complementary to the DNA, or a complementary sequence thereof. As used herein, these DNA and RNA molecules and the complementary polynucleotides thereof are collectively referred to as "CDR3 polynucleotides." For example, the CDR3 polynucleotides include, in addition to the DNAs comprising the nucleotide sequences shown in SEQ ID Nos.: 1-756, DNAs comprising these sequences. Also, for example, the CDR3 polynucleotides include, in addition to the RNAs complementary to the DNAs comprising the nucleotide sequences shown in SEQ ID Nos.: 1-756, RNAs comprising these sequences. Further, for example, the CDR3 polynucleotides include polynucleotides having the sequences of the DNAs or RNAs, and polynucleotides complementary to the RNAs. The "CDR polynucleotides" include those having degenerate sequences encoding "CDR3 peptides."

In another aspect, the present invention provides peptides having the amino acid sequences of CDR3 of the Vβ chain of T-cell receptors (TCRs) of WT1-specific cytotoxic T-cells (CTLs), which CDR3 amino acid sequences being shown in any of SEQ ID Nos.: 757-1512. As used herein, these peptides are collectively referred to as "CDR3 peptides." For example, the CDR3 peptides include, in addition to a peptide comprising any of the CDR3 amino acid sequences shown in SEQ ID Nos.: 757-1512, peptides comprising these CDR3 amino acid sequences (such as, for example, Vβ chain peptides or a portion thereof). In addition, a peptide consisting or comprising the amino acid sequence shown in SEQ ID Nos.: 757-1512 in which one or a few, preferably one to three, one or two, or one amino acid is substituted, added, or deleted is included in the "CDR3 peptides." However, these peptides are required to have equivalent functions to the original peptide. These CDR3 peptides are encoded by the above-mentioned CDR3 polynucleotides.

The CDR3 regions are the most diverse portions and are the most responsible parts for the specificity of antigen recognition. Thus, the sequences of the CDR3 polynucleotides and CDR3 peptides of the present invention are considered peculiar to WT1-specific CTL in HLA-A*0201-positive patients. Therefore, provided that the polynucleotide encoding the CDR3 region of the gene for the TCR Vβ chain of a certain T-cell or the peptide corresponding to the CDR3 region have the sequence of the polynucleotide or peptide of the present invention, the T-cell is considered as specific for WT1. Accordingly, the CDR3 polynucleotides and CDR3 peptides of the present invention may find use as markers for a wide variety of cancers, use in applications such as diagnosis of cancer, diagnosis of the susceptibility of patients to WT1 peptide immunotherapy, and tests for the responsiveness in the patients to WT1 peptide immunotherapy.

The CDR3 polynucleotides and CDR3 peptides of the present invention may be present in the lymphocytes of patients with any type of cancer as long as the cancer is generated from cells containing WT1. WT1 is known as a cancer antigen in a variety of cancers and hematological malignancies. Thus, the CDR3 polynucleotides and CDR3 peptides of the present invention, as well as the methods of the present invention described below, regardless of whether solid cancer or hematological cancer, may be applied to almost all the types of cancers including, but not limited to, for example, hematologic malignancies, such as acute myelocytic leukemia, acute lymphocytic leukemia, malignant lymphoma, multiple myeloma, chronic myelocytic leukemia, myelodysplastic syndrome, and recurrence after the transplantation of hematopoietic stem cells of the same type; solid cancers, such as tongue cancer, gingival cancer, mouth floor cancer, pharyngeal cancer, larynx cancer, salivary gland cancer, and thyroid cancer; thoracic cancers, such as breast cancer, lung cancer, and thymic cancer; gastrointestinal cancers, such as colon cancer, small intestine cancer, gastric cancer, pancreatic cancer, liver cancer, bile duct cancer, gastrointestinal endocrine tumor, and gastrointestinal carcinoid; cancers of urinary and genital tract, such as renal cancer, urothelial cancer, germinoma, Wilms' tumor, prostate cancer, uterine body cancer, cervical cancer, uterine sarcoma, and ovarian malignancy; musculoskeletal malignancies, such as primary malignancy of bone (e.g., osteosarcoma and Ewing's sarcoma) and soft tissue sarcoma; and other cancers, such as skin cancer, neuroblastoma, malignant glioma (glioblastoma), primary malignant lymphoma of the central nervous system, medulloblastoma, and PNET.

When producing CDR3 polynucleotides or CDR3 peptides, conventional genetic engineering techniques and/or chemical synthetic procedures may be used. For example, CDR3 polynucleotides may be isolated from cells or chemically synthesized. CDR3 polynucleotides may also be amplified using a known method, such as PCR. Also, for example, a CDR3 polynucleotide (optionally amplified to an appropriate level using a known method) may be integrated into a suitable vector and introduced into suitable cells, or may be introduced into suitable cells by biolistic bombardment or electroporation. Then the cells into which the CDR3 polynucleotide is introduced are cultured for expression, thereby obtaining the CDR3 polynucleotide or peptide. Available vectors and cells, conditions for gene transfer, culture conditions, and methods for isolating genes and peptides are known to those skilled in the art and appropriately selected for use. Chemical synthesis may be used to produce CDR3 polynucleotides or CDR3 peptides. Methods for such chemical synthesis are known, and the methods for chemical synthesis of genes include solid-phase DNA synthesis using amidite, and the 1-4 phosphonate method; the methods for chemical synthesis of peptides include the Fmoc method.

Thus, in a further aspect, the present invention provides a method for diagnosing cancer in an HLA-A*0201-positive patient, the method including assessing the clonality of WT1-specific CTL having any of the CDR3 polynucleotides or CDR3 peptides in a sample obtained from the patient before therapy, wherein in case that a WT1-specific CTL having a multiplicity of clonality is present, a higher possibility of developing cancer in the patient before therapy is determined when the types of a WT1-specific CTL with a multiplicity of clonality are more abundant, or when the clonality of a WT1-specific CTL with a multiplicity of clonality is higher. As used herein, the term "clonality" refers to the frequency of detection of cells having an identical nucleotide or amino acid sequence. To examine clonality, it is general to use a cell sorter that allows identification of individual cells. The "patients" include both humans suspected to have cancer and those suffering from cancer. When the method is performed, the types of a WT1-specific CTL with a multiplicity of clonality or the clonality of a WT1-specific CTL with a multiplicity of clonality may be compared with that of humans not suffering from cancer.

The inventors have found that it is possible to determine whether a patient develops cancer or not by examining the clonality of WT1-specific CTL having any of the CDR3 polynucleotides or CDR3 peptides in the patient. As can be seen from FIGS. 1-1 to 1-9 and 2-1 to 2-13, in the healthy individuals (HD1 to HD5), the clonality of WT1-specific CTL having any of the CDR3 polynucleotides or CDR3 peptides is 1 for almost all the clones, 2 or 3 for rare clones, and 4 for rarer clone (only 1 clone); however, by contrast, all the cancer patients before therapy (PT1 to PT6) have a multiplicity of clonality of the WT1-specific CTLs having any of the CDR3 polynucleotides or CDR3 peptides without exception. The number of the clonality is larger and the types of such cells are more abundant than those of the healthy individuals. The increases in clonality and in types of cells having a multiplicity of clonality in patients before therapy indicate a possibility that defense and attack against cancer cells has already been launched in the patients.

In view of these results, the possibility of cancer in a patient may be determined if a multiplicity of clonality is found in the WT1-specific CTL having any of the CDR3 polynucleotides or CDR3 peptides when examining a sample from a subject. Further, it is possible to determine that the larger the clonality of WT1-specific CTL having any of the CDR3 polynucleotides or CDR3 peptides, or the more abundant the types of WT1-specific CTLs having a multiplicity of clonality, the higher the possibility of developing cancer is in the subject before therapy. Also, in the determination method, it is possible to determine that the higher the possibility of developing cancer in the patient before therapy is when the clonality of WT1-specific CTL having any of the CDR3 polynucleotides or CDR3 peptides and having the clonality of 3 or more is larger, or the types of WT1-specific CTL having the clonality of 3 or more are more abundant.

In a further aspect, the present invention provides a method for testing for the sensitivity of an HLA-A*0201-positive patient to WT1 peptide immunotherapy, the method including assessing the clonality and the number of types of WT1-specific CTL clones having any of the polynucleotides of claim 1 or any of the peptides of claim 2 in a sample obtained from the patient before therapy, wherein the patient is determined to have the sensitivity to WT1 peptide immunotherapy when the types of WT1-specific CTL clones with a multiplicity of clonality are more abundant in the patient than in non-responsive subjects.

WT1-specific CTLs having any of the CDR3 polynucleotides or CDR3 peptides act against cancer cells in the patients. In this process, the clones that already have a multiplicity of clonality before therapy are considered to further increase the clonality or maintain their clonality by WT1 peptide immunotherapy. It is also considered that WT1 immunotherapy is more likely to be successful when there are clones of as many types as possible, which gives increased number and types of effective WT1-specific CTL clones as a whole. More strictly speaking, the sensitivity of a patient to WT1 peptide immunotherapy may be determined as being high when the types of WT1-specific CTL clones with a multiplicity of clonality are more abundant in the patient than in non-responsive subjects.

An increase in the clonality of a certain clone indicates that the WT1 peptide immunotherapy showed its effect for a certain period of time. Even if the clonality of certain clones may increase temporarily and then decrease, the clonality of other WT1-specific CTLs would increase to complement the effect. Considering the effect on cancer cells, a larger increase in the clonality is more desired. Therefore, the larger becomes the increase in the clonality or the more abundant become the types of clones with increased clonality after the WT1 peptide immunotherapy, the responsiveness to the WT1 peptide immunotherapy is considered to have been high.

In a further aspect, the present invention provides a method for monitoring WT1 peptide immunotherapy in an HLA-A*0201-positive patient, the method including assessing the clonality of WT1-specific CTL clones having any of the polynucleotides of claim 1 or any of the peptides of claim 2 in a sample obtained from the patient before and after the therapy, wherein the patient is determined to have responded to WT1 peptide immunotherapy when the clonality of any of the WT1-specific CTL clones increases after the therapy compared to before the therapy.

The presence of clones that increases their clonality due to WT1 peptide immunotherapy indicates the responsiveness to the WT1 peptide immunotherapy. In other words, the increase in the clonality suggests that the WT1 peptide immunotherapy showed its effect for a certain period of time. These increases in clonality may be transient or sustained. If the clonality of certain clones may increase only temporarily and then decrease, the clonality of other WT1-specific CTLs would increase to complement the effect. Considering the effect on cancer cells, a larger increase in the clonality is more desired. Therefore, the larger becomes the increase in the clonality or the more abundant become the types of clones with increased clonality after the WT1 peptide immunotherapy, the patient may be determined to have higher responsiveness to the WT1 peptide immunotherapy. The number and properties of cancer cells may be examined using an appropriate method depending on the type and site of the cancer.

In the above-described method for monitoring therapy, although the clonality is compared before and after WT1 peptide immunotherapy, the time period between before and after the therapy may be of any length. For example, it may be a few days, one week, two, three, or four weeks, or two or three months or more.

In the methods of the present invention described above, the means and methods for assessing clonality and determining the types of clones (i.e., determining the amino acid sequences of CDR3 peptides or the nucleotide sequences encoding the same) are known in the art, and those skilled in the art may conveniently carry out these operations. For example, as shown in Examples in the specification, a known sorting apparatus, such as the FACSAria system, and a method for gene amplification, such as PCR (using, for example, a primer set selected from the sequences listed in Table 1), may be used. In order to analyze the CDR3 polynucleotides or CDR peptides of the present invention in a stricter or more definite manner, one has only to confirm whether the nucleotide sequences of CDR3 (international ImMunoGeneTics information system, IMGT®) and the J and D regions in the Vβ chain gene are shown in FIGS. 1-1 to 1-9 and 2-1 to 2-13. Such confirmation is well within the ordinary skill of the art.

WT1 peptide immunotherapy is also known. For example, it may be performed on HLA-A*0201-positive patients by administering HLA-A*0201-restricted WT1 peptide (for example, $WT1_{126}$: amino acid sequence: RMFPNAPYL (SEQ ID No: 1543) or $WT1_{187}$: amino acid sequence: SLGEQQYSV (SEQ ID No: 1544)) via, for example, a transdermal route. In general, a single dose is in the order of μg/kg body weight to mg/kg body weight, and it may be administered at an interval of one week to a few weeks.

In a further aspect, the present invention provides a chip comprising the CDR3 polynucleotides or the polynucleotides complementary thereto; a chip comprising the CDR3 peptides; or a chip comprising antibodies against the CDR3 peptides. The chips may be in the form of microchips, microarrays, and the like. The production of the chips may be conducted according to conventional methods; for example, antibodies raised against the CDR3 polynucleotides or CDR3 peptides may be immobilized on a glass substrate. The species of the CDR3 polynucleotides or the polynucleotides complementary thereto, the CDR3 peptides, or the antibodies against the CDR3 peptides that is immobilized on the chip may be one to all; preferably, all the species are immobilized for exhaustive analysis. For example, all the polynucleotides comprising the nucleotide sequences complementary to the nucleotide sequences shown in SEQ ID Nos.: 1-756 may be immobilized on the chip; alternatively, for example, antibodies that specifically recognize and bind to all the peptides comprising the amino acid sequences shown in SEQ ID Nos.: 757-1512 may be immobilized on the chip. The CDR3 polynucleotides or the polynucleotides complementary thereto, the CDR3 peptides, or the antibodies against the CDR3 peptides may be placed at any position on the chip.

The chips may be used for, for example, diagnosis of cancer as described above. The samples may be affected tissues, body fluids such as blood and lymphatic fluid, or mucosal membranes. Preferably, the samples are peripheral blood. For example, when CDR3 polynucleotides are to be analyzed, the nucleic acids are extracted from the cells according to conventional methods, and a chip onto which all the species of polynucleotides comprising the nucleotide sequences complementary to the nucleotide sequences shown in SEQ ID Nos.: 1-756 are immobilized may be used to examine the species and quantity of the hybridized DNA present in the sample. Also, for example, when CDR3 peptides are to be analyzed, a chip onto which antibodies that specifically recognize and bind to all the species of peptides comprising the amino acid sequences shown in SEQ ID Nos.: 757-1512 are immobilized may be used to examine the species and quantity of the specifically bound peptides present in the sample.

In this regard, the present invention provides an antibody that specifically recognizes and binds to a CDR3 peptide. Preferably, such an antibody specifically recognizes and binds to any of the amino acid sequences shown in SEQ ID Nos.: 757-1512. Methods for preparing such an antibody are known to those skilled in the art.

Typically, DNAs in the sample or DNA sequences placed on the chip are labeled so that the presence or absence, or the amount of hybridization is indicated. For example, the presence or absence, or the species of CDR3 peptides in a sample may be identified by arraying antibodies for each of the CDR3 peptides of SEQ ID Nos.: 757-1512 on a chip and testing for their specific binding to the CDR3 peptides present in the sample. Typically, the peptides in the sample or the antibodies on the chip are labeled so that the presence or absence of the specific binding can be determined. Labels capable of indicating the presence or absence and the amount of hybridization or specific binding are known and include, for example, fluorescent labels, radioactive labels, enzyme labels, and chromophore labels. One skilled in the art may conveniently select suitable labels. The chips described above may be used to analyze a plurality of samples at the same time.

The CDR3 polynucleotides and CDR peptides of the present invention may be analyzed and identified using a known method, such as Southern blotting, Northern blotting, colony hybridization, and ELISA, as well as using the chips described above.

As described above, the CDR3 DNAs of the present invention have been identified using the primers shown in Examples, particularly, the primer sets shown in Table 1. Therefore, the present invention provides primers for amplifying CDR polynucleotides, which primers having the sequences selected from the sequences shown in SEQ ID Nos.: 1513-1538. For example, a primer set comprising the primers shown in SEQ ID Nos.: 1513-1538 may be used for amplification of a CDR3 polynucleotide.

The present invention also provides a kit for diagnosing cancer including means for detecting a WT1-specific CTL having a CDR3 polynucleotide or CDR3 peptide; a kit for testing for the sensitivity of a patient to WT1 peptide immunotherapy; or a kit for monitoring WT1 peptide immunotherapy. The present invention further provides a device for cancer diagnosis including means for detecting a WT1-specific CTL having a CDR3 polynucleotide or CDR3 peptide; a device for testing for the sensitivity of a cancer patient to WT1 peptide immunotherapy; or a device for monitoring WT1 peptide immunotherapy. A part for amplifying genes, such as a primer set, as described above, a chip as described above, or means for analyzing the information obtained from the chip may be used in the kit as a component or in the device.

In still another aspect, the present invention relates to a lymphocyte from an HLA-A*0201-positive patient, which lymphocyte incorporating a T-cell receptor gene containing a sequence of a CDR3 polynucleotide. HLA-A*0201-positive individuals include humans not suffering from cancer and cancer patients. A HLA-A*0201-positive individual may be, for example, a healthy individual, a donor for bone-marrow transplant or a cancer patient. Preferably, such a lymphocyte is a peripheral blood lymphocyte into which the gene for the Vβ chain of TCR of WT1-specific CTLs comprising a CDR3 polynucleotide of the present invention, and a gene for the Vβ chain of TCR of WT1-specific CTLs. In preparation of such a peripheral blood lymphocyte, a single species of the gene for the Vβ chain of TCR of WT1-specific CTLs may be used to obtain a plurality of types of peripheral blood lymphocytes, which are in turn introduced into patients. However, in view of improving the therapeutic effect, it is preferred to use a plurality of species of the gene for the Vβ chain of TCR of WT1-specific CTLs to obtain a plurality of types of peripheral blood lymphocytes, which are in turn introduced into patients. Alternatively, it is also preferred to select the nucleotide sequences of a suitable gene to be introduced depending on individual circumstances, because the therapeutically effective nucleotide sequences in the gene may differ depending on patients and cancer types. In addition, as used herein, the term "treatment" of cancer includes not only procedure of tumor such as inhibition of cancer progression, reduction of cancer, disappearance of cancer, and the like, but also prevention of cancer recurrence.

Methods for preparing a gene to be introduced and for introducing the gene into peripheral blood lymphocytes are known in the art. For example, a gene to be introduced may be integrated into a suitable vector and then introduced into suitable cells, or may be introduced into suitable cells by biolistic bombardment or electroporation. Other conditions for gene transfer and for cell culture may be appropriately selected by those skilled in the art.

The lymphocytes into which a gene has been introduced as described above may be cultured ex vivo to obtain a large amount of WT1-specific CTLs. Then, the WT1-specific CTLs obtained may be introduced into a cancer patient to kill tumor cells expressing WT1, thereby performing cancer therapy. When such a cancer therapy is performed, it is preferred that a gene is introduced as described above into peripheral blood lymphocytes obtained from a cancer patient who should be treated and the obtained WT1-specific CTLs are introduced into the same cancer patient.

The cancer therapy described above may be combined with other cancer therapies including anti-cancer agents and radiotherapy. The cancer therapy described above has a wide range of applications. They are exemplified above, but are not limited thereto.

In still another aspect, the present invention provides an antibody against a CDR3 peptide and a method of use thereof. Methods for preparing such an antibody are known in the art. Such an antibody may be used to detect or identify a lymphocyte having the amino acid sequence of the CDR3 peptide of the present invention or an amino acid sequence containing the above sequence in its Vβ chain in the subject sample. For example, antibodies against peptides comprising the amino acid sequences of any of SEQ ID Nos.: 757-1512 may be used to detect or identify cancer-specific lymphocytes. These antibodies may also be used to carry out the methods of the present invention, for example, the method for diagnosing cancer.

Such an antibody may also be contacted with lymphocytes having the amino acid sequence of CDR3 of the present invention to activate them. The lymphocytes thus activated may be used to treat cancer. Preferably, lymphocytes obtained from a cancer patient are activated and, if necessary, proliferated, and the cancer therapy is conducted by returning the lymphocytes to the patient. Such an antibody may also be used to enrich the WT1-specific T-cells of interest. For example, such an antibody may be used to enrich the WT1-specific T-cells in a cancer patient, thereby assisting the cancer therapy.

In a further aspect, the present invention provides a method for identifying the position and size of a solid cancer, the method including: administering the peripheral blood lymphocytes of the present invention described above after being labeled with a detectable label, and then examining the location and quantity of the label. The label may be a known label, such as radioactive label, e.g. Tecnecium-99, and fluorescent label. Methods for labeling cells are also known. Detection of labels and quantification of signals are also known in the art; they can be performed using a radiation counter, by fluorescence assay, or by obtaining a tissue sample by biopsy.

The present invention is illustrated in greater detail below with reference to Examples, but it should be understood that the present invention is not construed as being limited thereto.

EXAMPLE 1

A. Experimental Methods and Materials Used (1) Cell Samples

Peripheral blood samples were obtained from five healthy volunteers (HD1 to HD5) and six HLA-A*0201-positive solid cancer patients (PT1 to PT6). HLA alleles of healthy individuals and cancer patients are HD1:0201/2402, HD2: 0201/0206, HD3:0201/2602, HD4:0201/3303, HD5:0201/2402, PT1:0201/2402, PT2:0201/2402, PT3:0201/2402, PT4:0201/2402, PT5:0201/2402, PT6:0201/2402. The obtained peripheral blood samples were subjected to Ficoll-Hypaque (Pharmacia, Uppsala, Sweden) density gradient centrifugation and peripheral blood mononuclear cells (PBMCs) were separated and stored frozen at −170° C. until use.

(2) Flow Cytometric Analysis and Sorting

Initially, $2\times10^6$ PBMCs per sample were stained with PE-conjugated HLA-A*0201-WT1 126-134 tetramers (MBL, Tokyo, Japan) in FACS buffer (PBS containing 2% fetal bovine serum) at 37° C. for 30 minutes. Subsequently, they were stained with monoclonal antibodies labeled with five different fluorescent dyes as described below for 25 minutes on ice in dark: FITC-labeled anti-CD4, CD14, CD16, CD19, and CD56, anti-CD3-PerCP, anti-CD8-APC-Cy7 (BD Bioscience, San Jose, Calif.), anti-CD45RA-APC, and anti-CCR7-PE-Cy7 (BD Pharmingen, San Diego, Calif.). The stained cells were washed twice in FACS buffer. Sorting was performed using the FACSAria™ system (BD Biosciences) and data analysis was performed using the FACSDiva™ software (BD Biosciences). As a result, single HLA-A*0201-WT1$_{126-134}$ tetramer$^+$CD3$^+$CD8$^+$ cells were obtained from the fraction of CD4$^-$CD14$^-$CD16$^-$CD19$^-$CD56$^-$ cells and were defined as WT1-Tet$^+$ cells.

(3) cDNA Synthesis of the TCR-β Chain from the Sorted Single Cells

The single Val-Tet+ cells obtained as described above were sorted directly in a PCR tube containing a reaction mixture (reaction volume 20 μl), cDNA synthesis was carried out by incubation at 50° C. for 90 minutes, and then the samples were incubated at 95° C. for 5 minutes for terminating the reaction. The compositions of RT reaction solutions are shown in Table 1.

TABLE 1

| Component | Final concentration |
|---|---|
| RT buffer (containing Triton™ X-100) | 1x |
| Cb-RT primer caccagtgtggcctttg (SEQ ID No: 1513) | 200 nM |
| dNTP | 0.5 mM |
| Rnase inhibitor (Invitrogen) | 0.875 U/μl |
| SuperScript® III (Invitrogen) | 4.5 U/μl |
| gelatin | 100 μg/ml |
| tRNA | 100 μg/ml |

(4) PCR Reaction

Ten μl of a synthesized cDNA product obtained by the above procedure was added to 40 μl of a reaction mixture in order to perform 1st PCR reaction. The procedure of PCR was as follows: a pre-PCR heating step at 95° C. for 9 minutes, followed by 40 cycles of a denaturing step at 95° C. for 45 seconds, an annealing step at 57° C. for 45 seconds, and an extension step at 72° C. for 50 seconds. The compositions of 1st PCR reaction solutions are shown in Table 2.

TABLE 2

| Component | Final concentration |
|---|---|
| PCR buffer (not containing Mg) | 1x |
| MgCl$_2$ | 2 mM |
| dNTP | 0.25 mM |
| Platinum® Taq DNA polymerase (Invitrogen) | 0.02 U/μl |
| Cb-RT primer (reverse) | 5 nM |
| Vb PCR-1~3 primer mix (forward) | 5 nM of each primer |

* Vb PCR-1 mix contained S1 mix, S2 mix and S7 mix. Vb PCR-2 mix contained S3 mix, S4 mix and S8 mix. Vb PCR-3 mix contained S5 mix and S6 mix.

Next, the above PCR products were subjected to 2nd PCR (screening PCR). The above PCR products were placed in separate 8 tubes, respectively, and a reaction mixture was added to each of the tubes. The procedure of PCR was as follows: a pre-PCR heating step at 95° C. for 9 minutes, followed by 35 cycles of a denaturing step at 94° C. for 45 seconds, an annealing step at 57° C. for 45 seconds, and an extension step at 72° C. for 40 seconds. The compositions of 2nd PCR reaction solutions are shown in Table 3.

TABLE 3

| Component | Final concentration |
|---|---|
| PCR buffer (not containing Mg) | 1x |
| MgCl$_2$ | 2.5 mM |
| dNTP | 0.2 mM |
| Platinum® Taq DNA polymerase (Invitrogen) | 0.0125 U/μl |
| universal Cb primer ggaacacgttttcaggtcct (SEQ ID No: 1514) (reverse) | 150 nM |
| S mix primer (forward) ** | 150 nM |

** Each of S1 mix primer~S8 mix primer was added to each of eight tubes.

Each of S mix primer contained primers shown in Table 4.

TABLE 4

| | | |
|---|---|---|
| S1 mix primer | Vb1/5 | acagcaagtgac<tag>ctgagatgctc (SEQ ID No: 1515~1517) |
| | Vb11 | gatcactctggaatgttctcaaacc (SEQ ID No: 1518) |
| | Vb12 | ccaagacacaaggtcacagagaca (SEQ ID No: 1519) |
| S2 mix primer | Vb2 | gagtgccgttccctggactttcag (SEQ ID No: 1520) |
| | Vb3 | gtaacccagagctcgagatatcta (SEQ ID No: 1521) |
| | Vb22 | ggtcacacagatgggacaggaagt (SEQ ID No: 1522) |
| S3 mix primer | Vb4 | tccagtgtcaagtcgatagccaagtc (SEQ ID No: 1523) |
| | Vb6.a | atgtaact<ct>tcaggtgtgatccaa (SEQ ID No: 1524~1525) |
| | Vb14 | gtgacccagaacccaagataccctc (SEQ ID No: 1526) |
| S4 mix primer | Vb6.b | gtgtgatccaatttcaggtcatac (SEQ ID No: 1527) |
| | Vb8 | ggtgacagagatgggacaagaagt (SEQ ID No: 1528) |
| | Vb21 | cagtctcccagatataagattatagag (SEQ ID No: 1529) |
| S5 mix primer | Vb17 | cactcagtccccaaagtacctgtt (SEQ ID No: 1530) |
| | Vb20 | gtcagatctcagactattcatcaatgg (SEQ ID No: 1531) |
| | Vb7 | tacgcagacaccaa<ga>acacctggtca (SEQ ID No: 1532~1533) |
| | Vb9 | cccagactccaaaatacctggtca (SEQ ID No: 1534) |
| | Vb18 | tgcagaacccaagacacctggtca (SEQ ID No: 1535) |
| S6 mix primer | Vb10 | aaggtcacccagagacctagactt (SEQ ID No: 1536) |
| | Vb16 | atagaagctggagttactcagttc (SEQ ID No: 1537) |
| | Vb19 | acaaagatggattgtacccccgaa (SEQ ID No: 1538) |
| S7 mix primer | Vb13 | gtgtcactcagaccccaaaattcc (SEQ ID No: 1539) |
| | Vb15 | gttacccagaccccaaggaatagg (SEQ ID No: 1540) |

TABLE 4 -continued

| S8 mix primer | Vb23 | ctgatcaaagaaaagagggaaacagcc (SEQ ID No: 1541) |
| | Vb24 | caagataccaggttacccagtttg (SEQ ID No: 1542) |

In the table 4, "< >" means that one nucleotide is selected from listed nucleotides. For example, in case ". . . <ct> . . ." is represented, this means that there are two sequences, i.e., ". . . c . . ." and ". . . t . . .".

To verify positive reactions in the 8 screening PCRs, 5 μl of each screening PCR product was subjected to 2% agarose gel electrophoresis, followed by further PCR. This PCR was performed by 3rd PCR reaction using each of the Vβ-specific forward primers contained in the S mix primer sets that were confirmed as positive and the samples obtained as described above as templates. The procedure of PCR was as follows: a pre-PCR heating step at 95° C. for 9 minutes, followed by 35 cycles of a denaturing step at 94° C. for 45 seconds, an annealing step at 57° C. for 45 seconds, and an extension step at 72° C. for 40 seconds. The compositions of 2nd PCR reaction solutions are shown in Table 5. The reaction products were applied to 2% agarose gel electrophoresis to verify the positive reaction. The experiment was performed according to the same procedure as above using a cell-free system as a negative control.

TABLE 5

| Component | Final concentration |
|---|---|
| PCR buffer (not containing Mg) | 1x |
| MgCl₂ | 2.5 mM |
| dNTP | 0.2 mM |
| Platinum® Taq DNA polymerase (Invitrogen) | 0.0125 U/μl |
| universal Cb primer (reverse) | 150 nM |
| Vb mix primer (forward)*** | 200 nM |

***For example, when the positive reaction had verified in the reaction system using the above S1 mix primer, 3rd PCR reaction was performed using each of Vb1/5, Vb11 and Vb12 which were components of S1 mix primer.

(5) Determination and Analysis of the Sequences of the Complementarity-Determining Region 3 (CDR3) of TCR-β

The 3rd PCT products were applied to 2% agarose gel electrophoresis to verify the positive reaction. Amplified fragments of the TCR-β gene were purified using the QIAquick™ PCR Purification kit (Qiagen, Valencia, Calif.). Corresponding Vb primers were used for sequencing. The ABI PRIAM BigDye® Terminator v 3.1 Cycle Sequencing kit (Applied Biosystems, Foster City, Calif., USA) was used for sequencing, and the ABI PRISM® 3100 Genetic Analyzer (Applied Biosystems) was used for analysis. The sequence data on CDR3 were analyzed by comparing the sequences with those available from the website of the IMGT® human TCR gene database
(http://imgt (dot) cines (dot) fr/IMGT_vquest/vquest?livret=0&Option=humanTcRfor).

B. Results

In the present invention, the base sequences of 636 genes for the TCR β chain in peripheral blood mononuclear cell from five HLA-A*0201-positive healthy individuals (HD1 to HD5) and six HLA-A*0201-positive cancer patients (PT1 to PT6) could be determined, and the amino acid sequences encoded by the genes could be determined. The sequences of the gene for the Vβ chain, the J region sequences, D region sequences, N region sequences, CDR3 nucleotide sequences, and CDR3 amino acid sequences of WT1-specific CTLs derived from healthy individuals (HD1 to HD5) and cancer patients (PT1 to PT6) are shown in FIGS. 1-1 to 1-9. The clonality of WT1-specific CTLs of each individual is shown in FIGS. 2-1 to 2-13. The CDR3 nucleotide sequences are shown in SEQ ID Nos.: 1-636, and the CDR3 amino acid sequences are shown in SEQ ID Nos.: 757-1392 according to the ID NO numbering in FIGS. 1-1 to 1-9.

In addition, according to the above-described procedure, CDR3 nucleotide sequence and CDR3 amino acid sequence were determined from peripheral blood samples of one HLA-A*0201-positive thyroid cancer patient (PT7) and one HLA-A*0201-positive healthy individual (HD6). CDR3 nucleotide sequences obtained from PT7 and HD6 are shown in SEQ ID Nos.: 637-756 and CDR3 amino acid sequences obtained from PT7 and HD6 are shown in SEQ ID Nos.: 1393-1512.

As can be seen from FIGS. 2-1 to 2-13, in the healthy individuals (HD1 to HD5), the clonality of WT1-specific CTL having any of the CDR3 polynucleotides or CDR3 peptides is 1 for almost all the clones, 2 or 3 for rare clones, and 4 for rarer clone (only 1 clone); however, all the cancer patients before therapy (AMLs and MDSs) have a multiplicity of clonality of the WT1-specific CTLs having any of the CDR3 polynucleotides or CDR3 peptides without exception. The number of the clonality tended to be larger and the types of such cells tended to be more abundant in the cancer patients than in the healthy individuals. Specifically, PT1: 4 types (clonality of 30 in total); PT2: 10 types (clonality of 38 in total); PT3: 8 types (clonality of 26 in total); PT4: 4 types (clonality of 9 in total); PT5: 9 types (clonality of 20 in total); and PT6: 5 types (clonality of 13 in total). On the other hand, in healthy individuals HD1 to HD5, the types of clones with a multiplicity of clonality in each individual are 1 to 5 types and the clonality in total was 2 to 10.

Hereinbefore, the present invention was described for the case where HLA-A allele was A*0201; however, the present application can be applicable for the case where HLA-A allele is A*0206.

INDUSTRIAL APPLICABILITY

The present invention provides pharmaceutical compositions useful for anti-cancer therapy, cancer test kits or reagents, reagents for cancer research, and the like. Therefore, the present invention may find use in the fields of pharmaceuticals for cancer therapy, of cancer test kits or reagents, and of cancer research.

SEQUENCE LISTING (3044 sequences)

SEQ ID NO: 1 - DNA, 45 bp, Homo sapiens
tgtgccagcaaaccagggaccacccggaacaatgagcagttcttc

SEQ ID NO: 2 - DNA, 33 bp, Homo sapiens
tgtgccagcatggatgggtctgagcagttcttc

SEQ ID NO: 3 - DNA, 45 bp, Homo sapiens
tgtgcctccccccccctcaacaggggcgaaaatgagcagttcttc

SEQ ID NO: 4 - DNA, 48 bp, Homo sapiens
tgtgccagccaaaacttagcgggccctcagtacaatgagcagttcttc

SEQ ID NO: 5 - DNA, 36 bp, Homo sapiens
tgtgccagcagagatcggagaaacaccatatatttt

SEQ ID NO: 6 - DNA, 36 bp, Homo sapiens
tgtgccagcaggggggagggattagaagctttcttt

SEQ ID NO: 7 - DNA, 42 bp, Homo sapiens
tgtgccagcagaggtcaacagaatttctatggctacaccttc

SEQ ID NO: 8 - DNA, 45 bp, Homo sapiens
tgtgccagcagtgcgggacaggtttttcccggggagctgtttttt

SEQ ID NO: 9 - DNA, 42 bp, Homo sapiens
tgtgccagcagtgcaagactcaatgtggagacccagtacttc

SEQ ID NO: 10 - DNA, 45 bp, Homo sapiens
tgtgccagcagtgacgccgcggctaccaattacgagcagtacttc

SEQ ID NO: 11 - DNA, 45 bp, Homo sapiens
tgtgccagcagtgatggagggggggcgcaagagacccagtacttc

SEQ ID NO: 12 - DNA, 45 bp, Homo sapiens
tgtgccagcagtgacggcgggggggcgagtgagacccagtacttc

SEQ ID NO: 13 - DNA, 48 bp, Homo sapiens
tgtgccagcagtgaagcgcattgggacaggcaagagacccagtacttc

SEQ ID NO: 14 - DNA, 45 bp, Homo sapiens
tgtgccagcagtgaagcgcttatgacattctacgagcagtacttc

SEQ ID NO: 15 - DNA, 48 bp, Homo sapiens
tgtgccagcagtgaagatcggcagaggacggatgagacccagtacttc

SEQ ID NO: 16 - DNA, 45 bp, Homo sapiens
tgtgccagcagtgaagggggcggggctcaagagacccagtacttc

SEQ ID NO: 17 - DNA, 45 bp, Homo sapiens
tgtgccagcagtgaaggcggtggggggcaggagacccagtacttc

SEQ ID NO: 18 - DNA, 45 bp, Homo sapiens
tgtgccagcagtgagggggggggcctcgccgagacccagtacttc

SEQ ID NO: 19 - DNA, 45 bp, Homo sapiens
tgtgccagcagtgagggacatccaagtcaatacgagcagtacttc

SEQ ID NO: 20 - DNA, 45 bp, Homo sapiens
tgtgccagcagtgaaacagggtctagcacagatacgcagtatttt

SEQ ID NO: 21 - DNA, 42 bp, Homo sapiens
tgtgccagcagtgaatggcaagggaattcacccctccacttt

SEQ ID NO: 22 - DNA, 45 bp, Homo sapiens
tgtgccagcagtgaatggacaggggataccggggagctgtttttt

SEQ ID NO: 23 - DNA, 42 bp, Homo sapiens
tgtgccagcagcattgggaccttgaacactgaagctttcttt

SEQ ID NO: 24 - DNA, 36 bp, Homo sapiens
tgtgccagcagcctcgtaggagaggtgtcactcttc

SEQ ID NO: 25 - DNA, 39 bp, Homo sapiens
tgtgccagcagcccgggggtaagtcagccccagcatttt

SEQ ID NO: 26 - DNA, 39 bp, Homo sapiens
tgtgccagcagtacgggacttcgagaaaaactgtttttt

SEQ ID NO: 27 - DNA, 51 bp, Homo sapiens
tgtgccagcagtgttccagacgggacagggggcgacaatggctacaccttc

SEQ ID NO: 28 - DNA, 45 bp, Homo sapiens
tgtgccagcagttgggtaggggactaccaagagacccagtacttc

SEQ ID NO: 29 - DNA, 42 bp, Homo sapiens
tgtgccaccgggactagcgggtaccgggagacccagtacttc

SEQ ID NO: 30 - DNA, 45 bp, Homo sapiens
tgtgccaccggttggggagattctagcacagatacgcagtatttt

SEQ ID NO: 31 - DNA, 51 bp, Homo sapiens
tgtgccacgcacgaggctagcgggaaatggggccaggagacccagtacttc

SEQ ID NO: 32 - DNA, 43 bp, Homo sapiens
tgacctgaatgaaacgttccgccggccctacgagcagtacttc

SEQ ID NO: 33 - DNA, 39 bp, Homo sapiens
tgtgccagccgctccttagcggggggtgagcagttcttc

SEQ ID NO: 34 - DNA, 42 bp, Homo sapiens
tgtgccagcagcggacgaccgggtggtgaaaaactgtttttt

SEQ ID NO: 35 - DNA, 51 bp, Homo sapiens
tgtgccagcagcctcgccctagcgggagggatctcctacgagcagtacttc

SEQ ID NO: 36 - DNA, 45 bp, Homo sapiens
tgtgccagcagcctagacagtgcctcctacaatgagcagttcttc

SEQ ID NO: 37 - DNA, 48 bp, Homo sapiens
tgtgccagcagcccgtttcggggggagattgtagagacccagtacttc

SEQ ID NO: 38 - DNA, 42 bp, Homo sapiens
tgtgccagcagcccgatagataaacccggggagctgtttttt

SEQ ID NO: 39 - DNA, 42 bp, Homo sapiens
tgcgccagcagcccaccccccggaggggaaaaactgtttttt

SEQ ID NO: 40 - DNA, 45 bp, Homo sapiens
tgtgccagcagcccgcgagcgggggcgggcggggagctgtttttt

SEQ ID NO: 41 - DNA, 45 bp, Homo sapiens
tgtgccagcagccaagaactttcccccccttacgagcagtacttc

SEQ ID NO: 42 - DNA, 48 bp, Homo sapiens
tgtgccagcagccaactcgaccggacgaacaccggggagctgtttttt

SEQ ID NO: 43 - DNA, 48 bp, Homo sapiens
tgtgccagcagccaactcgaaaccacccgtaagggaaaattgtttttt

SEQ ID NO: 44 - DNA, 39 bp, Homo sapiens
tgtgccagcagccaattaggggattttggctacaccttc

SEQ ID NO: 45 - DNA, 54 bp, Homo sapiens
tgtgccagcagccagagttcactagcgggagggccgagcggggagctgtttttt

SEQ ID NO: 46 - DNA, 51 bp, Homo sapiens
tgtgccagcagccaaaccgggtcacctcaaatcacagatacgcagtatttt

SEQ ID NO: 47 - DNA, 60 bp, Homo sapiens
tgtgccagcagccaagtagggagggaggtcagcgggagggccttggatgagcagttcttc

SEQ ID NO: 48 - DNA, 42 bp, Homo sapiens
tgtgccagcagccagtgggtcgggggcactgaagctttcttt

SEQ ID NO: 49 - DNA, 45 bp, Homo sapiens
tgtgccagcagctcccgagcgggagctggcggtgagcagttcttc

SEQ ID NO: 50 - DNA, 42 bp, Homo sapiens
tgtgccagcacccgcgggggtgggggttcggaagctttcttt

SEQ ID NO: 51 - DNA, 39 bp, Homo sapiens
tgcgccagcagccactcgaacaccggggagctgtttttt

SEQ ID NO: 52 - DNA, 54 bp, Homo sapiens
tgcgccagcagcctgactcaggcgggacagagcccagcctacgagcagtacttc

SEQ ID NO: 53 - DNA, 48 bp, Homo sapiens
tgcgccagcagcccacaactagcggagcgctcctacgagcagtacttc

SEQ ID NO: 54 - DNA, 39 bp, Homo sapiens
tgcgccagcagccaagcactttcctacgagcagtacttc

SEQ ID NO: 55 - DNA, 36 bp, Homo sapiens
tgcgccagcagccaagatggctacgagcagtacttc

SEQ ID NO: 56 - DNA, 42 bp, Homo sapiens
tgcgccagcagccaagatcaggggataatagaagctttcttt

SEQ ID NO: 57 - DNA, 57 bp, Homo sapiens
tgcgccagcagccaagatcagcagggggtgatggttttagcgcagccccagcatttt

SEQ ID NO: 58 - DNA, 39 bp, Homo sapiens
tgcgccagcagccaagatcgatcgaatgagcagttcttc

SEQ ID NO: 59 - DNA, 48 bp, Homo sapiens
tgcgccagcagccaagattggccagggagctcctacgagcagtacttc

SEQ ID NO: 60 - DNA, 48 bp, Homo sapiens
tgcgccagcagccaggaagcggggttactctacaatgagcagttcttc

SEQ ID NO: 61 - DNA, 45 bp, Homo sapiens
tgcgccagcagccaagaggcgaacaggggagaggtccagtacttc

SEQ ID NO: 62 - DNA, 42 bp, Homo sapiens
tgcgccagcagccaagagggttttaatcagccccagcatttt

SEQ ID NO: 63 - DNA, 42 bp, Homo sapiens
tgcgccagcagccaagagtcgttgaacactgaagctttcttt

SEQ ID NO: 64 - DNA, 45 bp, Homo sapiens
tgcgccagcagccagggggcagctggggccaacgtcctgactttc

SEQ ID NO: 65 - DNA, 36 bp, Homo sapiens
tgcgccagcagccagggagggagagagcagtacttc

SEQ ID NO: 66 - DNA, 48 bp, Homo sapiens
tgcgccagcagccaagttttgagtagggggtacggtgagcagttcttc

SEQ ID NO: 67 - DNA, 45 bp, Homo sapiens
tgcgccagcagccaagtgcaggggggggggactgaagctttcttt

SEQ ID NO: 68 - DNA, 42 bp, Homo sapiens
tgcgccagcagctctagcgggaccaccggggagctgtttttt

SEQ ID NO: 69 - DNA, 48 bp, Homo sapiens
tgtgccagcagccacgagcgggagcggaacaccggggagctgtttttt

SEQ ID NO: 70 - DNA, 45 bp, Homo sapiens
tgtgccagcagccaagatggcggggacacagatacgcagtatttt

SEQ ID NO: 71 - DNA, 42 bp, Homo sapiens
tgtgccagcagccaagatccggcctactatggctacaccttc

SEQ ID NO: 72 - DNA, 42 bp, Homo sapiens
tgtgccagcagccaagaggtggggtgggagacccagtacttc

SEQ ID NO: 73 - DNA, 48 bp, Homo sapiens
tgtgccagcagccaaggctggcaggcaaggggatcacccctccacttt

SEQ ID NO: 74 - DNA, 45 bp, Homo sapiens
tgtgccagcagccaatcaatgactagcgccgagacccagtacttc

SEQ ID NO: 75 - DNA, 42 bp, Homo sapiens
tgcgccagcagcccgacccccaggcccggggagctgtttttt

SEQ ID NO: 76 - DNA, 45 bp, Homo sapiens
tgcgccagcagccaagatggaacaggctcctacgagcagtacttc

SEQ ID NO: 77 - DNA, 45 bp, Homo sapiens
tgcgccagcagccaagatttaactagcggggatgagcagttcttc

SEQ ID NO: 78 - DNA, 51 bp, Homo sapiens
tgcgccagcagccaagataggaggggggtgggatggactgaagctttcttt

SEQ ID NO: 79 - DNA, 54 bp, Homo sapiens
tgcgccagcagcgagaataagattggagttgccgtatcctacgagcagtacttc

SEQ ID NO: 80 - DNA, 48 bp, Homo sapiens
tgcgccagcagcgagagacaggggaatatctactccgagcagtacttc

SEQ ID NO: 81 - DNA, 36 bp, Homo sapiens
tgcgccagcagctttattgagggggagcagttcttc

SEQ ID NO: 82 - DNA, 48 bp, Homo sapiens
tgcgccagcagcttcatgtcgggctccctggggaatgagcagttcttc

SEQ ID NO: 83 - DNA, 45 bp, Homo sapiens
tgcgccagcagctttagcgggagtggtaacattgagcagttcttc

SEQ ID NO: 84 - DNA, 42 bp, Homo sapiens
tgcgccagcagcggcgggctctctggggatgagcagttcttc

SEQ ID NO: 85 - DNA, 45 bp, Homo sapiens
tgcgccagcagcttggccacagggcaagtcggcgagcagtacttc

SEQ ID NO: 86 - DNA, 51 bp, Homo sapiens
tgcgccagcagcttggatagggaaacgctctctggaaacaccatatatttt

SEQ ID NO: 87 - DNA, 57 bp, Homo sapiens
tgcgccagcagcttgggcccttctcttctagcggaggtgggcaatgagcagttcttc

SEQ ID NO: 88 - DNA, 48 bp, Homo sapiens
tgcgccagcagcttggtcgtgaggggcgggcaagagacccagtacttc

SEQ ID NO: 89 - DNA, 51 bp, Homo sapiens
tgcgccagcagcctctatctatggggggagggccaaaatgagcagttcttc

SEQ ID NO: 90 - DNA, 45 bp, Homo sapiens
tgcgccagcagccccaccgccgggacacgctacgagcagtacttc

SEQ ID NO: 91 - DNA, 42 bp, Homo sapiens
tgcgccagcagctcggacggcagcggctatggctacaccttc

SEQ ID NO: 92 - DNA, 42 bp, Homo sapiens
tgcgccagcagttatacagactcgaacactgaagctttcttt

SEQ ID NO: 93 - DNA, 39 bp, Homo sapiens
tgtgccagccaaggtctcgccggcgatacgcagtatttt

SEQ ID NO: 94 - DNA, 45 bp, Homo sapiens
tgtgccagcagacaaacaggtctcctcacagatacgcagtatttt

SEQ ID NO: 95 - DNA, 45 bp, Homo sapiens
tgtgccagcagcttttcagggggccatcctatgggctacaccttc

SEQ ID NO: 96 - DNA, 42 bp, Homo sapiens
tgtgccagcagcttggaactagcgggagacgagcagtacttc

SEQ ID NO: 97 - DNA, 48 bp, Homo sapiens
tgtgccagcagcttgggggcgagagggtggggcaatgagcagttcttc

SEQ ID NO: 98 - DNA, 39 bp, Homo sapiens
tgtgccagcagcttgggaggacagcgtgaagctttcttt

SEQ ID NO: 99 - DNA, 45 bp, Homo sapiens
tgtgccagcagcttggggctagcgggaaaaaacgagcagtacttc

SEQ ID NO: 100 - DNA, 48 bp, Homo sapiens
tgtgccagcagcttgggttcgggaggtcccttcgatgagcagttcttc

SEQ ID NO: 101 - DNA, 45 bp, Homo sapiens
tgtgccagcagcttaactagcgggagtctcaacgagcagtacttc

SEQ ID NO: 102 - DNA, 51 bp, Homo sapiens
tgtgccagcagctcggacctccgttgggagggtgacactgaagctttcttt

SEQ ID NO: 103 - DNA, 48 bp, Homo sapiens
tgtgccagcagcttggaactagcgggggggcgggatacgcagtatttt

SEQ ID NO: 104 - DNA, 51 bp, Homo sapiens
tgtgccagcagccctgaattagcgggaggtcttttggagacccagtacttc

SEQ ID NO: 105 - DNA, 51 bp, Homo sapiens
tgtgccagcagccctcgatcccccgggactagcggagacgagcagtacttc

SEQ ID NO: 106 - DNA, 39 bp, Homo sapiens
tgtgccagcagccgagagcgctacaatgagcagttcttc

SEQ ID NO: 107 - DNA, 51 bp, Homo sapiens
tgtgccagcagctccaaagggccccaggcatcaaatgaaaaactgtttttt

SEQ ID NO: 108 - DNA, 45 bp, Homo sapiens
tgtgccagcagcgaggccgggacagggcgagagacccagtacttc

SEQ ID NO: 109 - DNA, 60 bp, Homo sapiens
tgtgccagcagcttggcggagctgggccggggcggacgcctccattacgagcagtacttc

SEQ ID NO: 110 - DNA, 48 bp, Homo sapiens
tgtgccagcagcttggcggtccagctagccaaaaacattcagtacttc

SEQ ID NO: 111 - DNA, 42 bp, Homo sapiens
tgtgccagcagcttgggggcgagtcgctacgagcagtacttc

SEQ ID NO: 112 - DNA, 42 bp, Homo sapiens
tgtgccagcagcttgggggcggtgctctacgagcagtacttc

SEQ ID NO: 113 - DNA, 42 bp, Homo sapiens
tgtgccagcagcttagggggcttgatctacgagcagtacttc

SEQ ID NO: 114 - DNA, 42 bp, Homo sapiens
tgtgccagcagcttgctctcccggccagatacgcagtatttt

SEQ ID NO: 115 - DNA, 42 bp, Homo sapiens
tgtgccagcagccgactagcgaattacaatgagcagttcttc

SEQ ID NO: 116 - DNA, 61 bp, Homo sapiens
tgtgccagcagctcgcctttctcaggactagcgggacacctactcctacgagcagtacttc

SEQ ID NO: 117 - DNA, 54 bp, Homo sapiens
tgtgccagcagcttagcttaccgccataggacggcctactacgagcagtacttc

SEQ ID NO: 118 - DNA, 48 bp, Homo sapiens
tgtgccagcagcttggaacgggagatgaacaccggggagctgtttttt

SEQ ID NO: 119 - DNA, 42 bp, Homo sapiens
tgtgccagcaccctggacgggtctaataatgagcagttcttc

SEQ ID NO: 120 - DNA, 45 bp, Homo sapiens
tgtgccagctgtgacgggactagagagagtgacattcagtacttc

SEQ ID NO: 121 - DNA, 39 bp, Homo sapiens
tgtgccagtggagggtttgagaaatatggctacaccttc

SEQ ID NO: 122 - DNA, 42 bp, Homo sapiens
tgtgccagcaggagctggggatatccggagacccagtacttc

SEQ ID NO: 123 - DNA, 45 bp, Homo sapiens
tgtgccagcagtgaagcggccgaatccaatcagccccagcatttt

SEQ ID NO: 124 - DNA, 48 bp, Homo sapiens
tgtgccagcagtgaagcggggcagggggttcgagagacccagtacttc

SEQ ID NO: 125 - DNA, 45 bp, Homo sapiens
tgtgccagcagtgaagaggcagggggcgcatctggctacaccttc

SEQ ID NO: 126 - DNA, 51 bp, Homo sapiens
tgtgccagcagtgaagaaggagggactagcgcctacaatgagcagttcttc

SEQ ID NO: 127 - DNA, 45 bp, Homo sapiens
tgtgccagcagtgaattcggggggagcaatcagccccagcatttt

SEQ ID NO: 128 - DNA, 45 bp, Homo sapiens
tgtgccagcagtgaaggagcgggggggcttgatacgcagtatttt

SEQ ID NO: 129 - DNA, 42 bp, Homo sapiens
tgtgccagcagtgaatggtccctcagggatgagcagttcttc

SEQ ID NO: 130 - DNA, 45 bp, Homo sapiens
tgtgccagcagttccgccgggactcctaactatggctacaccttc

SEQ ID NO: 131 - DNA, 48 bp, Homo sapiens
tgtgccagcagtacaggggcgaccgggactaatgaaaaactgtttttt

SEQ ID NO: 132 - DNA, 45 bp, Homo sapiens
tgtgccagcaccgagccccctgacagggccactgaagctttcttt

SEQ ID NO: 133 - DNA, 39 bp, Homo sapiens
tgtgccagcagtttcagcgtcgcctacgagcagtacttc

SEQ ID NO: 134 - DNA, 45 bp, Homo sapiens
tgtgccagcagtttggagacgctgaacaccggggagctgtttttt

SEQ ID NO: 135 - DNA, 48 bp, Homo sapiens
tgtgccagcagccccgatagcgggaagaacaccggggagctgtttttt

SEQ ID NO: 136 - DNA, 42 bp, Homo sapiens
tgtgccagcagtcaagcgggagaaagcgatacgcagtatttt

SEQ ID NO: 137 - DNA, 42 bp, Homo sapiens
tgtgccagcagttcgggactagcaacagatacgcagtatttt

SEQ ID NO: 138 - DNA, 39 bp, Homo sapiens
tgtgccagcagttggggcgctgacaatgagcagttcttc

SEQ ID NO: 139 - DNA, 45 bp, Homo sapiens
tgtgccagcagttggtcggtccttagcacagatacgcagtatttt

SEQ ID NO: 140 - DNA, 45 bp, Homo sapiens
tgtgccagcagttacgggctagcgggctcctacgagcagtacttc

SEQ ID NO: 141 - DNA, 42 bp, Homo sapiens
tgtgccagcagttaccttggggccaccaatgaagctttcttt

SEQ ID NO: 142 - DNA, 45 bp, Homo sapiens
tgtgccagcagttacctgggtgcaactaatgaaaaactgtttttt

SEQ ID NO: 143 - DNA, 48 bp, Homo sapiens
tgtgccagcagttactcgtcggacagggtatcagatacgcagtatttt

SEQ ID NO: 144 - DNA, 48 bp, Homo sapiens
tgtgccagcagttactcctcccggacaggccaagagacccagtacttc

SEQ ID NO: 145 - DNA, 42 bp, Homo sapiens
tgtgccagcagttactcgacaaactcctacgagcagtacttc

SEQ ID NO: 146 - DNA, 42 bp, Homo sapiens
tgtgccagcagttactcgactagcgcctacgagcagtacttc

SEQ ID NO: 147 - DNA, 48 bp, Homo sapiens
tgtgccagcaccgctcagggacagatcatctcctacgagcagtacttc

SEQ ID NO: 148 - DNA, 39 bp, Homo sapiens
tgtgccagcaccttagggcagaccggggagctgtttttt

SEQ ID NO: 149 - DNA, 39 bp, Homo sapiens
tgtgcctcccttgggagcgggcaagagacccagtacttc

SEQ ID NO: 150 - DNA, 36 bp, Homo sapiens
tgtgccagcagggggacaggttacgagcagtacttc

SEQ ID NO: 151 - DNA, 42 bp, Homo sapiens
tgtgccagcagaaagggacagcctccagatacgcagtatttt

SEQ ID NO: 152 - DNA, 48 bp, Homo sapiens
tgtgccagcagactactagcgggagtcccctcggatgagcagttcttc

SEQ ID NO: 153 - DNA, 39 bp, Homo sapiens
tgtgccagcagtcacagggccgcagatacgcagtatttt

SEQ ID NO: 154 - DNA, 39 bp, Homo sapiens
tgtgccagcagtttgggggctccctacgagcagtacttc

SEQ ID NO: 155 - DNA, 45 bp, Homo sapiens
tgtgccagcagtatgggggacagggaggactacgagcagtacttc

SEQ ID NO: 156 - DNA, 39 bp, Homo sapiens
tgtgccagcagcccctccgggaacatcgagcagtacttc

SEQ ID NO: 157 - DNA, 45 bp, Homo sapiens
tgtgccagcagttcgcccgggacaggggagtacgagcagtacttc

SEQ ID NO: 158 - DNA, 42 bp, Homo sapiens
tgtgccagcagttggggacaggtcattactgaagctttcttt

SEQ ID NO: 159 - DNA, 42 bp, Homo sapiens
tgtgccagcagttatggggaggagaattcacccctccacttt

SEQ ID NO: 160 - DNA, 33 bp, Homo sapiens
tgtgccagcagttatggggaaaccgctttcttt

SEQ ID NO: 161 - DNA, 45 bp, Homo sapiens
tgtgccagcagttacgggaagggcctctacaatgagcagttcttc

SEQ ID NO: 162 - DNA, 42 bp, Homo sapiens
tgtgccagcagttacgggttgggtcaagagacccagtacttc

SEQ ID NO: 163 - DNA, 33 bp, Homo sapiens
tgtgccagcagttatgggcgggaagctttcttt

SEQ ID NO: 164 - DNA, 48 bp, Homo sapiens
tgtgccagcagttacgggtgggcagcctctggaaacaccatatatttt

SEQ ID NO: 165 - DNA, 45 bp, Homo sapiens
tgtgccagcagttacctggacagggggctgggggagcagtacttc

SEQ ID NO: 166 - DNA, 42 bp, Homo sapiens
tgtgccagcagttatagggacgtcgcctacgagcagtacttc

SEQ ID NO: 167 - DNA, 48 bp, Homo sapiens
tgtgccagcagttactctgggacagggatcttcaatgagcagttcttc

SEQ ID NO: 168 - DNA, 42 bp, Homo sapiens
tgtgccagcagttactcagggactacagatacgcagtatttt

SEQ ID NO: 169 - DNA, 51 bp, Homo sapiens
tgtgccagcagttactcgaagggactagcggactcctacgagcagtacttc

SEQ ID NO: 170 - DNA, 42 bp, Homo sapiens
tgtgccagcagttactcgtctgggtggcagccgatggacttc

SEQ ID NO: 171 - DNA, 48 bp, Homo sapiens
tgtgccagcagttacacgcaggggcggacgaatgaaaaactgtttttt

SEQ ID NO: 172 - DNA, 42 bp, Homo sapiens
tgtgccagcaacagcgggggtccacccatcgagcagttcttc

SEQ ID NO: 173 - DNA, 39 bp, Homo sapiens
tgtgccagcagatatccccaggaccccgggcagtacttc

SEQ ID NO: 174 - DNA, 45 bp, Homo sapiens
tgtgccagcagtaatgccgccggacctcaagagacccagtacttc

SEQ ID NO: 175 - DNA, 42 bp, Homo sapiens
tgtgccagcagttcacttacaggaaatcagccccagcatttt

SEQ ID NO: 176 - DNA, 33 bp, Homo sapiens
tgtgccagcagttacggccacgagcagtacttc

SEQ ID NO: 177 - DNA, 45 bp, Homo sapiens
tgtgccagcagttacctgggacagcttacagatacgcagtatttt

SEQ ID NO: 178 - DNA, 42 bp, Homo sapiens
tgtgccagcagcttaggggctggcaccggggagctgtttttt

SEQ ID NO: 179 - DNA, 45 bp, Homo sapiens
tgtgccagcagccttccggggggcagtagttacgagcagtacttc

SEQ ID NO: 180 - DNA, 36 bp, Homo sapiens
tgtgccagcagcttaaggcccaatgagcagttcttc

SEQ ID NO: 181 - DNA, 36 bp, Homo sapiens
tgtgccagcagctcgttctcctacgagcagtacttc

SEQ ID NO: 182 - DNA, 54 bp, Homo sapiens
tgtgccagcagccacggggtgatttggagccctgacaccggggagctgtttttt

SEQ ID NO: 183 - DNA, 54 bp, Homo sapiens
tgtgccagcagccatttatacgcagcgggagaaggcaaaaacattcagtacttc

SEQ ID NO: 184 - DNA, 51 bp, Homo sapiens
tgtgccagcagcttagaaggtgggcctgttgtgggttcacccctccacttt

SEQ ID NO: 185 - DNA, 42 bp, Homo sapiens
tgtgccagcagcttacaacagggttggtacgagcagtacttc

SEQ ID NO: 186 - DNA, 36 bp, Homo sapiens
tgtgccagcagcccggggagcactgaagctttcttt

SEQ ID NO: 187 - DNA, 27 bp, Homo sapiens
tgtgccagcagcccccagggagactgg

SEQ ID NO: 188 - DNA, 39 bp, Homo sapiens
tgtgccagcagttctgtcccgtacaatgagcagttcttc

SEQ ID NO: 189 - DNA, 60 bp, Homo sapiens
tgtgccagcagctcttggactagcgggagttccgaaagctcctacaatgagcagttcttc

SEQ ID NO: 190 - DNA, 42 bp, Homo sapiens
tgtgccagcagcttggcagggggcttggatacgcagtatttt

SEQ ID NO: 191 - DNA, 39 bp, Homo sapiens
tgtgccagcagcttagacgtctcctacgagcagtacttc

SEQ ID NO: 192 - DNA, 39 bp, Homo sapiens
tgtgccagcagcttagaagggttaaatgagcagttcttc

SEQ ID NO: 193 - DNA, 39 bp, Homo sapiens
tgtgccagcagcttattcacagggagagagccgttcttc

SEQ ID NO: 194 - DNA, 48 bp, Homo sapiens
tgtgccagcagcttgggcgggagggccagctcctacgagcagtacttc

SEQ ID NO: 195 - DNA, 51 bp, Homo sapiens
tgtgccagcagcttaatccccgagggcgtcggcacagatacgcagtatttt

SEQ ID NO: 196 - DNA, 48 bp, Homo sapiens
tgtgccagcagcttattagacgggggttcctacaatgagcagttcttc

SEQ ID NO: 197 - DNA, 42 bp, Homo sapiens
tgtgccagcagcttaagcgcagggtctgccgagcagtacttc

SEQ ID NO: 198 - DNA, 48 bp, Homo sapiens
tgtgccagcagcttatctttgggaggggagagttcacccctccacttt

SEQ ID NO: 199 - DNA, 42 bp, Homo sapiens
tgtgccagcagcttaacggggatgaacactgaagctttcttt

SEQ ID NO: 200 - DNA, 42 bp, Homo sapiens
tgtgccagcagcccggggggcatggacactgaagctttcttt

SEQ ID NO: 201 - DNA, 36 bp, Homo sapiens
tgtgccagcagccccggcgggaatgagcagttcttc

SEQ ID NO: 202 - DNA, 45 bp, Homo sapiens
tgtgccagcagccccggactagacccctaccatgagcagttcttc

SEQ ID NO: 203 - DNA, 45 bp, Homo sapiens
tgtgccagcagccccggactagacccctacaatgagcagttcttc

SEQ ID NO: 204 - DNA, 45 bp, Homo sapiens
tgtgccagcagccccagcgggagtcccgccaatgagcagttcttc

SEQ ID NO: 205 - DNA, 45 bp, Homo sapiens
tgtgccagcagctctggggcgggggcgggctacgagcagtacttc

SEQ ID NO: 206 - DNA, 45 bp, Homo sapiens
tgtgccagcagctcccaggggacgaacaccggggagctgtttttt

SEQ ID NO: 207 - DNA, 39 bp, Homo sapiens
tgtgccagcagcttggggactagcgatgagcagttcttc

SEQ ID NO: 208 - DNA, 48 bp, Homo sapiens
tgtgccagcagcccgatgagcacggttttctcctacgagcagtacttc

SEQ ID NO: 209 - DNA, 54 bp, Homo sapiens
tgtgccagcagccagggtactagcgggcccggggccaccggggagctgtttttt

SEQ ID NO: 210 - DNA, 39 bp, Homo sapiens
tgtgccagcagccaacgtagaacagatacgcagtatttt

SEQ ID NO: 211 - DNA, 33 bp, Homo sapiens
tgtgccagcagctccggcgatgagcagttcttc

SEQ ID NO: 212 - DNA, 36 bp, Homo sapiens
tgtgccagcagctataggaccggggagctgtttttt

SEQ ID NO: 213 - DNA, 39 bp, Homo sapiens
tgtgctagcagcccgagtctcggtgaaaaactgtttttt

SEQ ID NO: 214 - DNA, 45 bp, Homo sapiens
tgtgccagcagcttcgggacagggagaagcggggagctgtttttt

SEQ ID NO: 215 - DNA, 45 bp, Homo sapiens
tgtgccagcagcttaaggcaggggccctcctacgagcagtacttc

SEQ ID NO: 216 - DNA, 36 bp, Homo sapiens
tgtgccagcagccccggtcatactgaagctttcttt

SEQ ID NO: 217 - DNA, 60 bp, Homo sapiens
tgtgccagcagcccccatagccccggactagcgggagtttcacaagagacccagtacttc

SEQ ID NO: 218 - DNA, 48 bp, Homo sapiens
tgtgccagcagccccttagcgggagggcctcagaatgagcagttcttc

SEQ ID NO: 219 - DNA, 51 bp, Homo sapiens
tgtgccagcagccctcccaatcgggagcatggcaccggggagctgtttttt

SEQ ID NO: 220 - DNA, 45 bp, Homo sapiens
tgtgccagcagctgggggggtggggcgaacactgaagctttcttt

SEQ ID NO: 221 - DNA, 39 bp, Homo sapiens
tgtgccagcaggcctatgggcacagatacgcagtatttt

SEQ ID NO: 222 - DNA, 33 bp, Homo sapiens
tgtgccagcagcgacgcgaaggagcagtacttc

SEQ ID NO: 223 - DNA, 45 bp, Homo sapiens
tgtgccagcagcttccccctgagttccctagagacccagtacttc

SEQ ID NO: 224 - DNA, 48 bp, Homo sapiens
tgtgccagcagcttcaggcagggggcaagcaccggggagctgtttttt

SEQ ID NO: 225 - DNA, 48 bp, Homo sapiens
tgtgccagcagcttttcaggagaccctggggccaacgtcctgactttc

SEQ ID NO: 226 - DNA, 42 bp, Homo sapiens
tgtgccagcagccaccgggacagaaactacgagcagtacttc

SEQ ID NO: 227 - DNA, 42 bp, Homo sapiens
tgtgccagcagcttagctttcggggacaatgagcagttcttc

SEQ ID NO: 228 - DNA, 48 bp, Homo sapiens
tgtgccagcagcttagcgcaggggggagacacagatacgcagtatttt

SEQ ID NO: 229 - DNA, 42 bp, Homo sapiens
tgtgccagcagcttggctagcgggcaagagacccagtacttc

SEQ ID NO: 230 - DNA, 48 bp, Homo sapiens
tgtgccagcagcttagcggttagcgggagttccgacgagcagtacttc

SEQ ID NO: 231 - DNA, 54 bp, Homo sapiens
tgtgccagcagcttagacagtatctcctactctggggccaacgtcctgactttc

SEQ ID NO: 232 - DNA, 45 bp, Homo sapiens
tgtgccagcagcttagagtcagactcgccctacgagcagtacttc

SEQ ID NO: 233 - DNA, 48 bp, Homo sapiens
tgtgccagcagcttaggtttcgggctagcgggagacgagcagttcttc

SEQ ID NO: 234 - DNA, 48 bp, Homo sapiens
tgtgccagcagcttagggtttggcagggaggccaacgtcctgactttc

SEQ ID NO: 235 - DNA, 42 bp, Homo sapiens
tgtgccagcagccttggattcggtcgggagacccagtacttc

SEQ ID NO: 236 - DNA, 48 bp, Homo sapiens
tgtgccagcagcttaggactagcgggctacaccggggagctgtttttt

SEQ ID NO: 237 - DNA, 45 bp, Homo sapiens
tgtgccagcagcttaggtctcgggccgcaaaacccccagcatttt

SEQ ID NO: 238 - DNA, 42 bp, Homo sapiens
tgtgccagcagcttggggcagggggaggaaaaactgtttttt

SEQ ID NO: 239 - DNA, 42 bp, Homo sapiens
tgtgccagcagcttagggacaggcacagatacgcagtatttt

SEQ ID NO: 240 - DNA, 48 bp, Homo sapiens
tgtgccagcagcttaggggtggggacggaaggggaaaaactgtttttt

SEQ ID NO: 241 - DNA, 45 bp, Homo sapiens
tgtgccagcagcttaggttggggagccaaaaacattcagtacttc

SEQ ID NO: 242 - DNA, 42 bp, Homo sapiens
tgtgccagcagcctggggtacggcgaagagacccagtacttc

SEQ ID NO: 243 - DNA, 45 bp, Homo sapiens
tgtgccagcagcttggggtacggggaaggggagacccagtacttc

SEQ ID NO: 244 - DNA, 45 bp, Homo sapiens
tgtgccagcagcttagggtacgggagcacagatacgcagtatttt

SEQ ID NO: 245 - DNA, 39 bp, Homo sapiens
tgtgccagcagcttaagagcgaacaatgagcagttcttc

SEQ ID NO: 246 - DNA, 45 bp, Homo sapiens
tgtgccagcagcttagttggggcatcggaaaacattcagtacttc

SEQ ID NO: 247 - DNA, 51 bp, Homo sapiens
tgtgccagcagcttagtgggcctcgggagctcctacaatgagcagttcttc

SEQ ID NO: 248 - DNA, 36 bp, Homo sapiens
tgtgccagcagcttatgggacgacgagcagtacttc

SEQ ID NO: 249 - DNA, 42 bp, Homo sapiens
tgtgccagcagcccggacagggagcctatgaagcagtacttc

SEQ ID NO: 250 - DNA, 39 bp, Homo sapiens
tgtgccagcagcccggacaggggaaacattcagtacttc

SEQ ID NO: 251 - DNA, 36 bp, Homo sapiens
tgtgccagcagccccggcccctacgagcagtacttc

SEQ ID NO: 252 - DNA, 45 bp, Homo sapiens
tgtgccagcagctcaggacagggggcacgtgagacccagtacttc

SEQ ID NO: 253 - DNA, 48 bp, Homo sapiens
tgtgccagcagctctcgaaggggacttgaagacaatgagcagttcttc

SEQ ID NO: 254 - DNA, 48 bp, Homo sapiens
tgtgccagcagctctaggtgggatgcctctggaaacaccatatatttt

SEQ ID NO: 255 - DNA, 51 bp, Homo sapiens
tgtgccagcagctcaacggacagggggcctcgggatcagccccagcatttt

SEQ ID NO: 256 - DNA, 57 bp, Homo sapiens
tgtgccagcaccccgacagggacacggctcgttgaggtaacctacgagcagtacttc

SEQ ID NO: 257 - DNA, 45 bp, Homo sapiens
tgtgccagcacgccttgggcggactcctacaatgagcagttcttc

SEQ ID NO: 258 - DNA, 51 bp, Homo sapiens
tgtgccagcggtaaccccaagggccagggggacaccggggagctgtttttt

SEQ ID NO: 259 - DNA, 36 bp, Homo sapiens
tgtgccagcggacagggggcctacgagcagtacttc

SEQ ID NO: 260 - DNA, 45 bp, Homo sapiens
tgtgccagcagcgccgacagtggggtcacctacgagcagtacttc

SEQ ID NO: 261 - DNA, 39 bp, Homo sapiens
tgtgccagcagcgccggggacccagatacgcagtatttt

SEQ ID NO: 262 - DNA, 42 bp, Homo sapiens
tgtgccagcagcgccccgtacgggggggagacccagtacttc

SEQ ID NO: 263 - DNA, 45 bp, Homo sapiens
tgtgccagcagcgcctcctccgggactacctacgagcagtacttc

SEQ ID NO: 264 - DNA, 42 bp, Homo sapiens
tgtgccagcagcgaccctaaccgggcagatacgcagtatttt

SEQ ID NO: 265 - DNA, 42 bp, Homo sapiens
tgtgccagcagcgaagagggggcgggctacgagcagtacttc

SEQ ID NO: 266 - DNA, 48 bp, Homo sapiens
tgtgccagcagtgagagcgggggggccgactacaatgagcagttcttc

SEQ ID NO: 267 - DNA, 42 bp, Homo sapiens
tgtgccagcagcggtgagggactaaactacgagcagtacttc

SEQ ID NO: 268 - DNA, 39 bp, Homo sapiens
tgtgccagcagcggccatttccaagagacccagtacttc

SEQ ID NO: 269 - DNA, 51 bp, Homo sapiens
tgtgccagcagcggactagcgggaggctctgggtacaatgagcagttcttc

SEQ ID NO: 270 - DNA, 51 bp, Homo sapiens
tgtgccagcagccatgctggggggagccgtggcaccggggagctgtttttt

SEQ ID NO: 271 - DNA, 45 bp, Homo sapiens
tgtgccagcagtcacggacaggccgcttggtatggctacaccttc

SEQ ID NO: 272 - DNA, 48 bp, Homo sapiens
tgtgccagcagcataggacattccgccgggtccggggagctgtttttt

SEQ ID NO: 273 - DNA, 39 bp, Homo sapiens
tgtgccagcagcctccgggggaacactgaagctttcttt

SEQ ID NO: 274 - DNA, 48 bp, Homo sapiens
tgtgccagcagcttatccggggcccctagatcagatacgcagtatttt

SEQ ID NO: 275 - DNA, 45 bp, Homo sapiens
tgtgccagcagccccgacaggggatgggacactgaagctttcttt

SEQ ID NO: 276 - DNA, 45 bp, Homo sapiens
tgtgccagcagcccactagctagggggaacactgaagctttcttt

SEQ ID NO: 277 - DNA, 45 bp, Homo sapiens
tgtgccagcagcccccggacagccatgaacactgaagctttcttt

SEQ ID NO: 278 - DNA, 45 bp, Homo sapiens
tgtgccagcagcccacggacagagcgcacagatacgcagtatttt

SEQ ID NO: 279 - DNA, 45 bp, Homo sapiens
tgtgccagcagccccacttttagcgggaggaatgagcagttcttc

SEQ ID NO: 280 - DNA, 42 bp, Homo sapiens
tgtgccagcagcccatgggggacagggtccgagcagtacttc

SEQ ID NO: 281 - DNA, 45 bp, Homo sapiens
tgtgccagcagccagggggccgagtaccaagagacccagtacttc

SEQ ID NO: 282 - DNA, 36 bp, Homo sapiens
tgtgccagcagctcctactcctacgagcagtacttc

SEQ ID NO: 283 - DNA, 39 bp, Homo sapiens
tgtgccagcagcgtagcttcccccggggagctgtttttt

SEQ ID NO: 284 - DNA, 51 bp, Homo sapiens
tgtgccagcagcgtagacgggagtcaatatcacaaaaacattcagtacttc

SEQ ID NO: 285 - DNA, 42 bp, Homo sapiens
tgtgccagcagcgtagacccagctagggacattcagtacttc

SEQ ID NO: 286 - DNA, 45 bp, Homo sapiens
tgtgccagcagcgtagactatcgggggaatcagccccagcatttt

SEQ ID NO: 287 - DNA, 39 bp, Homo sapiens
tgtgccagcagcgtagaagccaaaactgaagctttcttt

SEQ ID NO: 288 - DNA, 42 bp, Homo sapiens
tgtgccagcagcgtaggaggggacaccggggagctgtttttt

SEQ ID NO: 289 - DNA, 54 bp, Homo sapiens
tgtgccagcagcgtaggggggttggccgtcagctctggaaacaccatatatttt

SEQ ID NO: 290 - DNA, 48 bp, Homo sapiens
tgtgccagcagcgttgggggacgcacgatcgaggacgagcagtacttc

SEQ ID NO: 291 - DNA, 42 bp, Homo sapiens
tgtgccagcagcgtaggaggcagcaccggggagctgtttttt

SEQ ID NO: 292 - DNA, 42 bp, Homo sapiens
tgtgccagcagcgtagttccgaacacagatacgcagtatttt

SEQ ID NO: 293 - DNA, 42 bp, Homo sapiens
tgtgccagcagcgtagtttcgggaaccggggagctgtttttt

SEQ ID NO: 294 - DNA, 51 bp, Homo sapiens
tgcgccagcagtggcggtagcgggagtacatttcccaatgagcagttcttc

SEQ ID NO: 295 - DNA, 42 bp, Homo sapiens
tgcgccagcagtaaggacagcagctcctacgagcagtacttc

SEQ ID NO: 296 - DNA, 33 bp, Homo sapiens
tgcgccagcagccagggttacgagcagtacttc

SEQ ID NO: 297 - DNA, 42 bp, Homo sapiens
tgcgccagcagctctactccaacaaaagagacccagtacttc

SEQ ID NO: 298 - DNA, 36 bp, Homo sapiens
tgcgccagcagtgaccacggtccggggcagtacttc

SEQ ID NO: 299 - DNA, 45 bp, Homo sapiens
tgcgccagcagtgagtctatgggggggagtcagccccagcatttt

SEQ ID NO: 300 - DNA, 39 bp, Homo sapiens
tgcgccagcagcgggaggtggtacaatgagcagttcttc

SEQ ID NO: 301 - DNA, 36 bp, Homo sapiens
tgtgccatcatggacaggtcctacgagcagtacttc

SEQ ID NO: 302 - DNA, 51 bp, Homo sapiens
tgtgccatcagggccgggacagggggcgcggtggggactgaagctttcttt

SEQ ID NO: 303 - DNA, 39 bp, Homo sapiens
tgtgccatcagggatatgactcgcaatgagcagttcttc

SEQ ID NO: 304 - DNA, 42 bp, Homo sapiens
tgtgccatcagggaggacaggcggagttcacccctccacttt

SEQ ID NO: 305 - DNA, 51 bp, Homo sapiens
tgtgccatcagatcactagcgggagagaccccctacaatgagcagttcttc

SEQ ID NO: 306 - DNA, 45 bp, Homo sapiens
tgtgccatcagtgagcccgacaggggtgtctacgagcagtacttc

SEQ ID NO: 307 - DNA, 48 bp, Homo sapiens
tgtgccatcagtgagaggggagggacaggggcctacgagcagtacttc

SEQ ID NO: 308 - DNA, 45 bp, Homo sapiens
tgtgccatcagtgagtcgggcggtgggtcagagacccagtacttc

SEQ ID NO: 309 - DNA, 51 bp, Homo sapiens
tgtgccatcagtgagacccctagcgggaatcccacctacgagcagtacttc

SEQ ID NO: 310 - DNA, 42 bp, Homo sapiens
tgtgccaccgggacaggggatagcaatcagccccagcatttt

SEQ ID NO: 311 - DNA, 48 bp, Homo sapiens
tgtgccaccaactatggcctcgagacagggggatacgagcagtacttc

SEQ ID NO: 312 - DNA, 42 bp, Homo sapiens
tgtgccagcagcttagttggaacgtcctacgagcagtacttc

SEQ ID NO: 313 - DNA, 51 bp, Homo sapiens
tgtgccagcagctcccccggggaaatacaggtgacctacgagcagtacttc

SEQ ID NO: 314 - DNA, 45 bp, Homo sapiens
tgtgccagcagcgcaacaggaggattcacagatacgcagtatttt

SEQ ID NO: 315 - DNA, 36 bp, Homo sapiens
tgtgccagcagcgaatactactacgagcagtacttc

SEQ ID NO: 316 - DNA, 42 bp, Homo sapiens
tgtgccagcagctttaacagggtccgcgatacgcagtatttt

SEQ ID NO: 317 - DNA, 39 bp, Homo sapiens
tgtgccagcagcttagatttcgcagatacgcagtatttt

SEQ ID NO: 318 - DNA, 54 bp, Homo sapiens
tgtgccagcagcttagatcaggggggaggagggggatcctacgagcagtacttc

SEQ ID NO: 319 - DNA, 48 bp, Homo sapiens
tgtgccagcagccttgatagcgggagggcccaagatacgcagtatttt

SEQ ID NO: 320 - DNA, 45 bp, Homo sapiens
tgtgccagcagcttagaatctgtgaaccaagagacccagtacttc

SEQ ID NO: 321 - DNA, 48 bp, Homo sapiens
tgtgccagcagcttagaatatccggggacagggattgagcagtacttc

SEQ ID NO: 322 - DNA, 45 bp, Homo sapiens
tgtgccagcagcttaggggcgggaggcatctacgagcagtacttc

SEQ ID NO: 323 - DNA, 54 bp, Homo sapiens
tgtgccagcagcttgttgctagcgggagggcctagcacagatacgcagtatttt

SEQ ID NO: 324 - DNA, 45 bp, Homo sapiens
tgtgccagcagcttgaatagctatagcaatcagccccagcatttt

SEQ ID NO: 325 - DNA, 42 bp, Homo sapiens
tgtgccagcagcttagtactaggatacactgaagctttcttt

SEQ ID NO: 326 - DNA, 48 bp, Homo sapiens
tgtgccagcagcttagtcccgacaggggaggactatggctacaccttc

SEQ ID NO: 327 - DNA, 42 bp, Homo sapiens
tgtgccagcagccctcccacagggaacggggagctgtttttt

SEQ ID NO: 328 - DNA, 48 bp, Homo sapiens
tgtgccagcagcccacaaccgggactaggagcggagacccagtacttc

SEQ ID NO: 329 - DNA, 42 bp, Homo sapiens
tgtgccagcagccggacaggggggtacactgaagctttcttt

SEQ ID NO: 330 - DNA, 42 bp, Homo sapiens
tgtgccagcagccggtgggcggacaccaatgagcagttcttc

SEQ ID NO: 331 - DNA, 45 bp, Homo sapiens
tgtgccagcagctcgaatgtgggagagggcaatgagcagttcttc

SEQ ID NO: 332 - DNA, 45 bp, Homo sapiens
tgtgccagcagctcccctagcgggggcacctacgagcagtacttc

SEQ ID NO: 333 - DNA, 48 bp, Homo sapiens
tgtgccagcagttgggggggggattctagcacagatacgcagtatttt

SEQ ID NO: 334 - DNA, 45 bp, Homo sapiens
tgtgccagcagctactttgacagcgtgaacactgaagctttcttt

SEQ ID NO: 335 - DNA, 51 bp, Homo sapiens
tgtgccagcagcttggatgggacatttcttcgcacagatacgcagtatttt

SEQ ID NO: 336 - DNA, 39 bp, Homo sapiens
tgtgccagcagcttagacagctcctacgagcagtacttc

SEQ ID NO: 337 - DNA, 39 bp, Homo sapiens
tgtgccagcagcttgggccaaggctacgagcagtacttc

SEQ ID NO: 338 - DNA, 54 bp, Homo sapiens
tgtgccagcagctgggggtgggagagcgggagggcgttcgatgagcagttcttc

SEQ ID NO: 339 - DNA, 54 bp, Homo sapiens
tgtgccagcatagaaatgatcggacaggggccgaacaccggggagctgtttttt

SEQ ID NO: 340 - DNA, 42 bp, Homo sapiens
tgtgccagccccacagtagggttactagagacccagtacttc

SEQ ID NO: 341 - DNA, 42 bp, Homo sapiens
tgtgccagccccacagtaaggttactagagacccagtacttc

SEQ ID NO: 342 - DNA, 39 bp, Homo sapiens
tgtgccagcaggcccgggactagcaaggagcagtacttc

SEQ ID NO: 343 - DNA, 42 bp, Homo sapiens
tgtgccagcagtttcgagacaggtagatacgagcagtacttc

SEQ ID NO: 344 - DNA, 42 bp, Homo sapiens
tgtgccagcagtttcgggggagagggagagacccagtacttc

SEQ ID NO: 345 - DNA, 36 bp, Homo sapiens
tgtgccagcagttttcgagagtacgagcagtacttc

SEQ ID NO: 346 - DNA, 45 bp, Homo sapiens
tgtgccagcagtttttggggccctgacgattcacccctccacttt

SEQ ID NO: 347 - DNA, 42 bp, Homo sapiens
tgtgccagcagtttagaggggaagatggttgaagctttcttt

SEQ ID NO: 348 - DNA, 39 bp, Homo sapiens
tgtgccagcagtttaggcagcacagatacgcagtatttt

SEQ ID NO: 349 - DNA, 42 bp, Homo sapiens
tgtgccagcagtttacaagggaacaccggggagctgtttttt

SEQ ID NO: 350 - DNA, 45 bp, Homo sapiens
tgtgccagcagtaacgggcaagtttggaacactgaagctttcttt

SEQ ID NO: 351 - DNA, 45 bp, Homo sapiens
tgtgccagcagtcccggggagggtcgcacagatacgcagtatttt

SEQ ID NO: 352 - DNA, 39 bp, Homo sapiens
tgtgccagcagtccccctgcgggcactgaagctttcttt

SEQ ID NO: 353 - DNA, 48 bp, Homo sapiens
tgtgccagcagtcgcaaccgggacagggaaaactatggctacaccttc

SEQ ID NO: 354 - DNA, 48 bp, Homo sapiens
tgtgccagcagtcggcagggggcagcgccggccaacgtcctgactttc

SEQ ID NO: 355 - DNA, 45 bp, Homo sapiens
tgtgccagcagtcgaagttcgtctagcacagatacgcagtatttt

SEQ ID NO: 356 - DNA, 36 bp, Homo sapiens
tgtgccagcagttcagctaactatggctacaccttc

SEQ ID NO: 357 - DNA, 36 bp, Homo sapiens
tgtgccagcagttcagcgaactatggctacaccttc

SEQ ID NO: 358 - DNA, 36 bp, Homo sapiens
tgtgccagcaccgactctcctgaaaaactgtttttt

SEQ ID NO: 359 - DNA, 48 bp, Homo sapiens
tgtgccagcacctctaggaccgtaagctcctacaatgagcagttcttc

SEQ ID NO: 360 - DNA, 33 bp, Homo sapiens
tgtgccgtagcgcacacagatacgcagtatttt

SEQ ID NO: 361 - DNA, 45 bp, Homo sapiens
tgtgctagtggagacgggtcaaccgggggagagacccagtacttc

SEQ ID NO: 362 - DNA, 57 bp, Homo sapiens
tgtgctagtggtttgtccaggactagcgggactatgtcctacaatgagcagttcttc

SEQ ID NO: 363 - DNA, 45 bp, Homo sapiens
tgtgctagtggttccggacagggcagggacaatgagcagttcttc

SEQ ID NO: 364 - DNA, 45 bp, Homo sapiens
tgtgccagcagcgcgggacagccggggagctacgagcagtacttc

SEQ ID NO: 365 - DNA, 36 bp, Homo sapiens
tgtgccagcagcttggacgtgggtgagcagttcttc

SEQ ID NO: 366 - DNA, 48 bp, Homo sapiens
tgtgccagcagcttagaaggactatcgaacaccggggagctgtttttt

SEQ ID NO: 367 - DNA, 45 bp, Homo sapiens
tgtgccagcagcttaggcaggggactaaatcagccccagcatttt

SEQ ID NO: 368 - DNA, 45 bp, Homo sapiens
tgtgccagcagccaactacagcagggcctcactgaagctttcttt

SEQ ID NO: 369 - DNA, 48 bp, Homo sapiens
tgtgccagcagctcccacggaactcaaggctcctacgagcagtacttc

SEQ ID NO: 370 - DNA, 39 bp, Homo sapiens
tgtgccagcagcccggacaggggcaatgagcagttcttc

SEQ ID NO: 371 - DNA, 42 bp, Homo sapiens
tgtgccagcagccaagattacgtaatggacgagcagtacttc

SEQ ID NO: 372 - DNA, 51 bp, Homo sapiens
tgtgccagcagccagggacagttagcgggactcaactacgagcagtacttc

SEQ ID NO: 373 - DNA, 42 bp, Homo sapiens
tgtgccacacaagtcgggggcggctcctacgagcagtacttc

SEQ ID NO: 374 - DNA, 51 bp, Homo sapiens
tgtgccaccagcgacgagggacagggggcgcgcaccggggagctgtttttt

SEQ ID NO: 375 - DNA, 42 bp, Homo sapiens
tgtgccaccagcgagggcctcgcgttgggtgagcagttcttc

SEQ ID NO: 376 - DNA, 48 bp, Homo sapiens
tgtgccaccagttttagtagggacagaggcaatcagccccagcatttt

SEQ ID NO: 377 - DNA, 42 bp, Homo sapiens
tgtgccaccagcagagatatgctaacagatacgcagtatttt

SEQ ID NO: 378 - DNA, 45 bp, Homo sapiens
tgtgccaccagcagagacaggggtgggaccggggagctgtttttt

SEQ ID NO: 379 - DNA, 45 bp, Homo sapiens
tgtgccaccagcagagatagcatagggggcactgagcagttcttc

SEQ ID NO: 380 - DNA, 45 bp, Homo sapiens
tgtgccaccagcagaggcctagcgggagcctacgagcagtacttc

SEQ ID NO: 381 - DNA, 39 bp, Homo sapiens
tgtgccaccagctcaattcctggggaagccatatatttt

SEQ ID NO: 382 - DNA, 39 bp, Homo sapiens
tgtgccaccagcacaggacagggctacgagcagtacttc

SEQ ID NO: 383 - DNA, 48 bp, Homo sapiens
tgtgccagctcacctgcagggcgaacctactcctacgagcagtacttc

SEQ ID NO: 384 - DNA, 39 bp, Homo sapiens
tgtgccagctcacctgaggggggccccacgcagtatttt

SEQ ID NO: 385 - DNA, 33 bp, Homo sapiens
tgtgccagctcaccggggatcgagcagtacttc

SEQ ID NO: 386 - DNA, 42 bp, Homo sapiens
tgtgccagctcacccggacaggggtactatggctacaccttc

SEQ ID NO: 387 - DNA, 45 bp, Homo sapiens
tgtgccagctcaccccaggacctcctctactacgagcagtacttc

SEQ ID NO: 388 - DNA, 48 bp, Homo sapiens
tgtgccagctcaccacaatgggggacaggggagtatgagcagttcttc

SEQ ID NO: 389 - DNA, 45 bp, Homo sapiens
tgtgccagctcatcttacgggacagggggcgatgagcagttcttc

SEQ ID NO: 390 - DNA, 39 bp, Homo sapiens
tgtgccgcgaagatgggggtcaccggggagctgtttttt

SEQ ID NO: 391 - DNA, 39 bp, Homo sapiens
tgtgccagagacccggaggaggccaacgtcctgactttc

SEQ ID NO: 392 - DNA, 36 bp, Homo sapiens
tgtgccagcggaccgcctaactatggctacaccttc

SEQ ID NO: 393 - DNA, 45 bp, Homo sapiens
tgtgccagtatgggtttcgggagtgcgacagatacgcagtatttt

SEQ ID NO: 394 - DNA, 33 bp, Homo sapiens
tgtgccagtagaggagcgggcgccctccacttt

SEQ ID NO: 395 - DNA, 42 bp, Homo sapiens
tgtgccagtaggggacagggggcgcgtaatgagcagttcttc

SEQ ID NO: 396 - DNA, 42 bp, Homo sapiens
tgtgccagtagatctagcgggagggccctcgagcagtacttc

SEQ ID NO: 397 - DNA, 45 bp, Homo sapiens
tgtgccagtagtgcggacagggggcttattcagccccagcatttt

SEQ ID NO: 398 - DNA, 45 bp, Homo sapiens
tgtgccagtagtgcccggggacactctggaaacaccatatatttt

SEQ ID NO: 399 - DNA, 48 bp, Homo sapiens
tgtgccagtagtgctagcggagcgagctcctacaatgagcagttcttc

SEQ ID NO: 400 - DNA, 48 bp, Homo sapiens
tgtgccagtagtatagacgcggacaggggattgggcggctacaccttc

SEQ ID NO: 401 - DNA, 45 bp, Homo sapiens
tgtgccagtagtatagaactactaaacagagaaaaactgtttttt

SEQ ID NO: 402 - DNA, 48 bp, Homo sapiens
tgtgccagtagtataggtggcgggaggtggaacaatgagcagttcttc

SEQ ID NO: 403 - DNA, 51 bp, Homo sapiens
tgtgccagtagtatagggacagggggtttcttcgcgaatacgcagtatttt

SEQ ID NO: 404 - DNA, 45 bp, Homo sapiens
tgtgccagtagtattatgggacagggtggccagccccagcatttt

SEQ ID NO: 405 - DNA, 39 bp, Homo sapiens
tgtgccagtagtataccctggaccggggagctgtttttt

SEQ ID NO: 406 - DNA, 45 bp, Homo sapiens
tgtgccagtagtatacaggcaagctcctacaatgagcagttcttc

SEQ ID NO: 407 - DNA, 45 bp, Homo sapiens
tgtgccagtagtatacaattggttccagtggagacccagtacttc

SEQ ID NO: 408 - DNA, 48 bp, Homo sapiens
tgtgccagtagtattcgggcggaccccgcctacaatgagcagttcttc

SEQ ID NO: 409 - DNA, 48 bp, Homo sapiens
tgtgccagtagtatacggggctacctctcctacaatgagcagttcttc

SEQ ID NO: 410 - DNA, 39 bp, Homo sapiens
tgtgccagtagtatcactttctcctacgagcagtacttc

SEQ ID NO: 411 - DNA, 48 bp, Homo sapiens
tgtgccagtagtatagtcgcaggggcgagcaatcagccccagcatttt

SEQ ID NO: 412 - DNA, 39 bp, Homo sapiens
tgtgccagtagtatcgtacaaaccaatgagcagttcttc

SEQ ID NO: 413 - DNA, 48 bp, Homo sapiens
tgtgccagtagtatcgtcagtagccgatacacagatacgcagtatttt

SEQ ID NO: 414 - DNA, 42 bp, Homo sapiens
tgtgccagtagtaagggttatggcaatcagccccagcatttt

SEQ ID NO: 415 - DNA, 48 bp, Homo sapiens
tgtgccagtagtttagggacaggagagatgaacactgaagctttcttt

SEQ ID NO: 416 - DNA, 42 bp, Homo sapiens
tgtgccagtagtctcgggacggtgaacactgaagctttcttt

SEQ ID NO: 417 - DNA, 42 bp, Homo sapiens
tgtgccagtagtctttcagaaattcggtacgagcagtacttc

SEQ ID NO: 418 - DNA, 39 bp, Homo sapiens
tgtgccagtagtatgggagggccagatacgcagtatttt

SEQ ID NO: 419 - DNA, 45 bp, Homo sapiens
tgtgccagtagtatgtgggtggcgaacaccggggagctgtttttt

SEQ ID NO: 420 - DNA, 45 bp, Homo sapiens
tgtgccagtagtccacaccgggggggcaactatggctacaccttc

SEQ ID NO: 421 - DNA, 51 bp, Homo sapiens
tgtgccagtagtccccttagaggggactcgccctacaatgagcagttcttc

SEQ ID NO: 422 - DNA, 45 bp, Homo sapiens
tgtgccagtagtagggctccagaggggaacactgaggctttcttt

SEQ ID NO: 423 - DNA, 54 bp, Homo sapiens
tgtgccagtagttcctcggacagggcggtaatctggaccggggagctgtttttt

SEQ ID NO: 424 - DNA, 45 bp, Homo sapiens
tgtgccagtacggcgggagcctttacctacaatgagcagttcttc

SEQ ID NO: 425 - DNA, 57 bp, Homo sapiens
tgtgccagtaccgcgatcggggggacggggcaatatagcaatcagccccagcatttt

SEQ ID NO: 426 - DNA, 39 bp, Homo sapiens
tgtgccagtacagggtcaatattcaatgagcagttcttc

SEQ ID NO: 427 - DNA, 48 bp, Homo sapiens
tgtgccagtaccaacggactagcgggagtcgagggggagctgtttttt

SEQ ID NO: 428 - DNA, 48 bp, Homo sapiens
tgtgccagtaccccccgccccgcaggggagggtgaaaaactgtttttt

SEQ ID NO: 429 - DNA, 45 bp, Homo sapiens
tgtgccagtacccaggggagctcctataattcacccctccacttt

SEQ ID NO: 430 - DNA, 39 bp, Homo sapiens
tgtgccagtacctatagtgataccggggagctgtttttt

SEQ ID NO: 431 - DNA, 39 bp, Homo sapiens
tgtgccacggaaggacagggtttgggtgagcagttcttc

SEQ ID NO: 432 - DNA, 36 bp, Homo sapiens
tgcagtgccgaccacaggggggatgagcagttcttc

SEQ ID NO: 433 - DNA, 51 bp, Homo sapiens
tgcagtgccgactccttaacgggacagggggctggagatacgcagtatttt

SEQ ID NO: 434 - DNA, 45 bp, Homo sapiens
tgcagtgctttccggggggcaggggacacagatacgcagtatttt

SEQ ID NO: 435 - DNA, 45 bp, Homo sapiens
tgcagtgcctttgttggcgggagggactacaatgagcagttcttc

SEQ ID NO: 436 - DNA, 42 bp, Homo sapiens
tgcagtgcgggaccaggggatttgaacactgaagctttcttt

SEQ ID NO: 437 - DNA, 39 bp, Homo sapiens
tgcagtgccggacagggagaaagctcacccctccacttt

SEQ ID NO: 438 - DNA, 39 bp, Homo sapiens
tgcagtgccggtacgtcggaccttaatgagcagttcttc

SEQ ID NO: 439 - DNA, 36 bp, Homo sapiens
tgcagtgctaacgacgcacctgggggctacaccttc

SEQ ID NO: 440 - DNA, 36 bp, Homo sapiens
tgcagtgccaaccgggagcgagtcgagcagtacttc

SEQ ID NO: 441 - DNA, 39 bp, Homo sapiens
tgcagtgccccgggacagccgtacaatgagcagttcttc

SEQ ID NO: 442 - DNA, 51 bp, Homo sapiens
tgcagtgctcccgggactagcgggagcggggggatagatacgcagtatttt

SEQ ID NO: 443 - DNA, 39 bp, Homo sapiens
tgcagtgctccctcgggacagggctacgagcagtacttc

SEQ ID NO: 444 - DNA, 42 bp, Homo sapiens
tgcagtgcgccgtctagcgggaggtacaatgagcagttcttc

SEQ ID NO: 445 - DNA, 42 bp, Homo sapiens
tgcagtgcccccaccgagacaggggctgaaaaactgtttttt

SEQ ID NO: 446 - DNA, 42 bp, Homo sapiens
tgcagtgctcctaccggggtcttagtttatggctacaccttc

SEQ ID NO: 447 - DNA, 39 bp, Homo sapiens
tgcagtgctcaaggactgtatcctaatgagcagttcttc

SEQ ID NO: 448 - DNA, 48 bp, Homo sapiens
tgcagtgctagagctagcgggagttcgaacaccggggagctgtttttt

SEQ ID NO: 449 - DNA, 45 bp, Homo sapiens
tgcagtgctagagatttcggatcgagctcctacgagcagtacttc

SEQ ID NO: 450 - DNA, 45 bp, Homo sapiens
tgcagtgctagagatggggggagggacaccggggagctgtttttt

SEQ ID NO: 451 - DNA, 48 bp, Homo sapiens
tgcagtgctagagaccttagcgggagcgaagacaatgagcagttcttc

SEQ ID NO: 452 - DNA, 39 bp, Homo sapiens
tgcagtgctagagatcgcggctcctacgagcagtacttc

SEQ ID NO: 453 - DNA, 45 bp, Homo sapiens
tgcagtgctagagatagcgggagctcctgggatgagcagttcttc

SEQ ID NO: 454 - DNA, 45 bp, Homo sapiens
tgcagtgctagagatgtgggggcagggaccggggagctgtttttt

SEQ ID NO: 455 - DNA, 42 bp, Homo sapiens
tgcagtgctagagaggacagggagtatcagccccagcatttt

SEQ ID NO: 456 - DNA, 33 bp, Homo sapiens
tgcagtgctagagaggattacgagcagtacttc

SEQ ID NO: 457 - DNA, 42 bp, Homo sapiens
tgcagtgctagagaaggacacgaaagttcacccctccacttt

SEQ ID NO: 458 - DNA, 42 bp, Homo sapiens
tgcagtgctagggagggactagggcacctcgagcagtacttc

SEQ ID NO: 459 - DNA, 42 bp, Homo sapiens
tgcagtgctagagaaggtccgagctcctacgagcagtacttc

SEQ ID NO: 460 - DNA, 45 bp, Homo sapiens
tgcagtgcgagagaacttttgggggactcctacgagcagtacttc

SEQ ID NO: 461 - DNA, 36 bp, Homo sapiens
tgcagtgctagattccagtacaatgagcagttcttc

SEQ ID NO: 462 - DNA, 42 bp, Homo sapiens
tgcagtgctagaggagccgggaggggccatgagcagttcttc

SEQ ID NO: 463 - DNA, 36 bp, Homo sapiens
tgcagtgctagaggagacgaagagacccagtacttc

SEQ ID NO: 464 - DNA, 39 bp, Homo sapiens
tgcagtgctagagggttccgggcgggggagcagttcttc

SEQ ID NO: 465 - DNA, 45 bp, Homo sapiens
tgcagtgctagaggatttagcgggccaaattacgagcagtacttc

SEQ ID NO: 466 - DNA, 42 bp, Homo sapiens
tgcagtgctagagggccgttgcggttctatgagcagttcttc

SEQ ID NO: 467 - DNA, 48 bp, Homo sapiens
tgcagtgctaggcccggacagggcgggggttactacgagcagtacttc

SEQ ID NO: 468 - DNA, 45 bp, Homo sapiens
tgcagtgctagaagtgggactagcgcaccctacgagcagtacttc

SEQ ID NO: 469 - DNA, 42 bp, Homo sapiens
tgcagtgctagatccccttcgacagactacgagcagtacttc

SEQ ID NO: 470 - DNA, 39 bp, Homo sapiens
tgcagtgctagaagccagggagactacgagcagtacttc

SEQ ID NO: 471 - DNA, 39 bp, Homo sapiens
tgcagtgctaggtcgacagggttctacgagcagtacttc

SEQ ID NO: 472 - DNA, 42 bp, Homo sapiens
tgcagtgctaggtcgacagggggtgagactgaagctttcttt

SEQ ID NO: 473 - DNA, 36 bp, Homo sapiens
tgcagtgctagaactgggggggctgaagctttcttt

SEQ ID NO: 474 - DNA, 39 bp, Homo sapiens
tgcagtgccaggacagggtccaccggggagctgtttttt

SEQ ID NO: 475 - DNA, 45 bp, Homo sapiens
tgcagtgctagtaatatcgcgggaggacgcgagacccagtacttc

SEQ ID NO: 476 - DNA, 42 bp, Homo sapiens
tgcagtgctagccccgggacagataattcacccctccacttt

SEQ ID NO: 477 - DNA, 51 bp, Homo sapiens
tgcagtgctagccgccctcgcccgggtggcggatcctacgagcagtacttc

SEQ ID NO: 478 - DNA, 39 bp, Homo sapiens
tgcagtgctagctctctagcgggcaatgagcagttcttc

SEQ ID NO: 479 - DNA, 36 bp, Homo sapiens
tgcagtgctacgtcaaccgtctacgagcagtacttc

SEQ ID NO: 480 - DNA, 45 bp, Homo sapiens
tgcagtgcctaccaagaggacgtctctggaaacaccatatatttt

SEQ ID NO: 481 - DNA, 39 bp, Homo sapiens
tgcagtgacgcgacaggggagtcagatacgcagtatttt

SEQ ID NO: 482 - DNA, 45 bp, Homo sapiens
tgcagtggggatacgtgggaggccggacaagagacccagtacttc

SEQ ID NO: 483 - DNA, 39 bp, Homo sapiens
tgcagtggaaggaaggcagattcctacgagcagtacttc

SEQ ID NO: 484 - DNA, 54 bp, Homo sapiens
tgtgccagcagcaaagcgggggacacctttaggggccaagagacccagtacttc

SEQ ID NO: 485 - DNA, 45 bp, Homo sapiens
tgcgccagcagtcacctccagggttayggaaacaccatatatttt

SEQ ID NO: 486 - DNA, 45 bp, Homo sapiens
tgcgccagcagtcaaggagggggcgaggtggatgagcagttcttc

SEQ ID NO: 487 - DNA, 51 bp, Homo sapiens
tgcgccagcagtcaatctgcccccgggttggttgacaatgagcagttcttc

SEQ ID NO: 488 - DNA, 42 bp, Homo sapiens
tgtgccaccagtgatgccaacagcaatcagccccagcatttt

SEQ ID NO: 489 - DNA, 48 bp, Homo sapiens
tgtgccaccagtgatccgatgacagggggcacgaacgagcagtacttc

SEQ ID NO: 490 - DNA, 48 bp, Homo sapiens
tgtgccaccagtgattctccgggacagggatccggggagctgtttttt

SEQ ID NO: 491 - DNA, 48 bp, Homo sapiens
tgtgccaccagtgattaccgggacagcacctacaatgagcagttcttc

SEQ ID NO: 492 - DNA, 39 bp, Homo sapiens
tgtgccaccagtccggctatctacaatgagcagttcttc

SEQ ID NO: 493 - DNA, 51 bp, Homo sapiens
tgtgccaccagtcccgggactagcgggagactgagcaatgagcagttcttc

SEQ ID NO: 494 - DNA, 36 bp, Homo sapiens
tgtgccaccgtgttggggaacactgaagctttcttt

SEQ ID NO: 495 - DNA, 42 bp, Homo sapiens
tgtgccaccgtaagaaagatcaacaccggggagctgtttttt

SEQ ID NO: 496 - DNA, 45 bp, Homo sapiens
tgtgccagcagagaggactcctggtccttcggggagctgtttttt

SEQ ID NO: 497 - DNA, 36 bp, Homo sapiens
tgtgcctcccgtccaggcacagatacgcagtatttt

SEQ ID NO: 498 - DNA, 48 bp, Homo sapiens
tgtgccagcagtgaggagacagggggcacgagcactgaagctttcttt

SEQ ID NO: 499 - DNA, 45 bp, Homo sapiens
tgtgccagcagtcccggacagttcgacaccggggagctgtttttt

SEQ ID NO: 500 - DNA, 33 bp, Homo sapiens
tgtgccagcacagcgggggacaccatatatttt

SEQ ID NO: 501 - DNA, 45 bp, Homo sapiens
tgtgccatcctcaattctccgggacagtatcggacccagtacttc

SEQ ID NO: 502 - DNA, 51 bp, Homo sapiens
tgtgccaacacctttgatcccccgggacaggggaatcctgaagctttcttt

SEQ ID NO: 503 - DNA, 45 bp, Homo sapiens
tgtgccagcgccttttttggggaagcaggctatggctacaccttc

SEQ ID NO: 504 - DNA, 39 bp, Homo sapiens
tgtgccagcggggacagggagaatgaaaaactgtttttt

SEQ ID NO: 505 - DNA, 45 bp, Homo sapiens
tgtgccagcattttatccacgggaaacaatcacccccaccatttt

SEQ ID NO: 506 - DNA, 45 bp, Homo sapiens
tgtgccagcctctcccgggaggctcccttagatacgcagtatttt

SEQ ID NO: 507 - DNA, 36 bp, Homo sapiens
tgtgccagcaggggactatacaatgagcagttcttc

SEQ ID NO: 508 - DNA, 39 bp, Homo sapiens
tgtgccagcagaattgggacttacactgaagctttcttt

SEQ ID NO: 509 - DNA, 45 bp, Homo sapiens
tgtgccagccgccccagttggcgggaaggaggcgagcagtacttc

SEQ ID NO: 510 - DNA, 36 bp, Homo sapiens
tgtgccagccgacgagggtacaatgagcagttcttc

SEQ ID NO: 511 - DNA, 42 bp, Homo sapiens
tgtgccagccgtagcgggacgggcacagatacgcagtatttt

SEQ ID NO: 512 - DNA, 45 bp, Homo sapiens
tgtgccagcagtgcggactgggacagggaagctgaagctttcttt

SEQ ID NO: 513 - DNA, 42 bp, Homo sapiens
tgtgccagctctgccgggggtactaactatggctacaccttc

SEQ ID NO: 514 - DNA, 39 bp, Homo sapiens
tgtgccagcagcgaatttgtacaggagacccagtacttc

SEQ ID NO: 515 - DNA, 45 bp, Homo sapiens
tgtgccagcagtttcggcgggagggccctcaatgagcagttcttc

SEQ ID NO: 516 - DNA, 45 bp, Homo sapiens
tgtgccagcagtttcggattagcgaaatacaatgagcagttcttc

SEQ ID NO: 517 - DNA, 42 bp, Homo sapiens
tgtgccagcagtttctccggaactaatgaaaaactgtttttt

SEQ ID NO: 518 - DNA, 48 bp, Homo sapiens
tgtgccagcagtttcactctcgggacaggggggaacgagcagtacttc

SEQ ID NO: 519 - DNA, 48 bp, Homo sapiens
tgtgccagcagtttcacgactagcggagccacagatacgcagtatttt

SEQ ID NO: 520 - DNA, 45 bp, Homo sapiens
tgtgccagcagtctagcgggagacgggtacaatgagcagttcttc

SEQ ID NO: 521 - DNA, 42 bp, Homo sapiens
tgtgccagcagtttagcgggtagtaacactgaagctttcttt

SEQ ID NO: 522 - DNA, 36 bp, Homo sapiens
tgtgccagcagtcttgacaaggatacgcagtatttt

SEQ ID NO: 523 - DNA, 48 bp, Homo sapiens
tgtgccagcagtttatttggccaggtcgggtttactgaagctttcttt

SEQ ID NO: 524 - DNA, 45 bp, Homo sapiens
tgtgccagcagtttgttccagggaggtcccactgaagctttcttt

SEQ ID NO: 525 - DNA, 42 bp, Homo sapiens
tgtgccagcagtttaggcggtgggtggaatgagcagttcttc

SEQ ID NO: 526 - DNA, 36 bp, Homo sapiens
tgtgccagcagtttgcataccggggagctgtttttt

SEQ ID NO: 527 - DNA, 39 bp, Homo sapiens
tgtgccagcagtttaatcggacagattgagcagttcttc

SEQ ID NO: 528 - DNA, 51 bp, Homo sapiens
tgtgccagcagtttactacctcggcaggccccggggaatgagcagttcttc

SEQ ID NO: 529 - DNA, 54 bp, Homo sapiens
tgtgccagcagtttatcttttgggtctagcgggatccgccgagagcagttcttc

SEQ ID NO: 530 - DNA, 36 bp, Homo sapiens
tgtgccagcagtttggttaattcacccctccacttt

SEQ ID NO: 531 - DNA, 48 bp, Homo sapiens
tgtgccagcagtttatgggctagcgggagtacggatacgcagtatttt

SEQ ID NO: 532 - DNA, 39 bp, Homo sapiens
tgtgccagcagcctctacagttcctacgagcagtacttc

SEQ ID NO: 533 - DNA, 45 bp, Homo sapiens
tgtgccagcagtcccgaccggagctcctacaatgagcagttcttc

SEQ ID NO: 534 - DNA, 48 bp, Homo sapiens
tgtgccagcagtcccggactagcgggaacctacaatgagcagttcttc

SEQ ID NO: 535 - DNA, 45 bp, Homo sapiens
tgtgccagcagtccgggactaatcgggaccggggagctgtttttt

SEQ ID NO: 536 - DNA, 39 bp, Homo sapiens
tgtgccagcagcccggggcccaacaatgagcagttcttc

SEQ ID NO: 537 - DNA, 39 bp, Homo sapiens
tgtgccagcagtccgggtcgcacctacgagcagtacttc

SEQ ID NO: 538 - DNA, 48 bp, Homo sapiens
tgtgccagcagtcccccagggatagcgggagttaatgagcagttcttc

SEQ ID NO: 539 - DNA, 48 bp, Homo sapiens
tgtgccagcagtccccaaagctacagggttgaccagccccagcatttt

SEQ ID NO: 540 - DNA, 51 bp, Homo sapiens
tgtgccagcagtcggttttgggggggtgctagcacagatacgcagtatttt

SEQ ID NO: 541 - DNA, 42 bp, Homo sapiens
tgtgccagcagttccttacagggggacgacgagcagtacttc

SEQ ID NO: 542 - DNA, 48 bp, Homo sapiens
tgtgccagcagttcctcattagagacaggggacactgaagctttcttt

SEQ ID NO: 543 - DNA, 33 bp, Homo sapiens
tgtgccagcagtacggcctacgagcagtacttc

SEQ ID NO: 544 - DNA, 36 bp, Homo sapiens
tgtgccagcagcaccccaccgggggagcagtacttc

SEQ ID NO: 545 - DNA, 48 bp, Homo sapiens
tgtgccagcagttgggggggagggggttctatctacgagcagtacttc

SEQ ID NO: 546 - DNA, 39 bp, Homo sapiens
tgtgccagcagttggagggggaccggggagctgtttttt

SEQ ID NO: 547 - DNA, 42 bp, Homo sapiens
tgtgccagcagttggacagggtactcctacgagcagtacttc

SEQ ID NO: 548 - DNA, 42 bp, Homo sapiens
tgtgccagcaccgctgggctagcgaccggggagctgtttttt

SEQ ID NO: 549 - DNA, 42 bp, Homo sapiens
tgtgccagctacggaagggttagcaccggggagctgtttttt

SEQ ID NO: 550 - DNA, 45 bp, Homo sapiens
tgtgccacctggggaggggctgccggctcctacgagcagtacttc

SEQ ID NO: 551 - DNA, 45 bp, Homo sapiens
tgggccaccattttttcgggaacgggaaaaattgaccattttttc

SEQ ID NO: 552 - DNA, 39 bp, Homo sapiens
tgtgccagcaaaagcagcggaggggatacgcagtatttt

SEQ ID NO: 553 - DNA, 51 bp, Homo sapiens
tgtgccagcaaaactgtaaacaggggatttgggacagatacgcagtatttt

SEQ ID NO: 554 - DNA, 42 bp, Homo sapiens
tgtgccagcaacggagagcgggagggatacgagcagtacttc

SEQ ID NO: 555 - DNA, 42 bp, Homo sapiens
tgtgccagcagaaatagcgccgactcctacgagcagtacttc

SEQ ID NO: 556 - DNA, 57 bp, Homo sapiens
tgtgccagcaggaataccgacccctggggtgtgaggagcacagatacgcagtatttt

SEQ ID NO: 557 - DNA, 42 bp, Homo sapiens
tgtgccagcagaccaggacaggcatacaatgagcagttcttc

SEQ ID NO: 558 - DNA, 36 bp, Homo sapiens
tgtgccagcagacgccgtatgactgaagctttcttt

SEQ ID NO: 559 - DNA, 39 bp, Homo sapiens
tgtgccagcagaacggacgggtcggagacccagtacttc

SEQ ID NO: 560 - DNA, 39 bp, Homo sapiens
tgtgccagcagaactagcggcacagatacgcagtatttt

SEQ ID NO: 561 - DNA, 45 bp, Homo sapiens
tgtgccagcagtgccgggacaggcgggaacactgaagctttcttt

SEQ ID NO: 562 - DNA, 39 bp, Homo sapiens
tgtgccagcagtttcgcagaagcctacgagcagtacttc

SEQ ID NO: 563 - DNA, 48 bp, Homo sapiens
tgtgccagcagttttgaccgggacagggggcctcagccccagcatttt

SEQ ID NO: 564 - DNA, 42 bp, Homo sapiens
tgtgccagcagtttcgggttctctggaaacaccatatatttt

SEQ ID NO: 565 - DNA, 42 bp, Homo sapiens
tgtgccagcagtttcgggggtcctaacactgaagctttcttt

SEQ ID NO: 566 - DNA, 39 bp, Homo sapiens
tgtgccagcagtttcctgggttacactgaagctttcttt

SEQ ID NO: 567 - DNA, 42 bp, Homo sapiens
tgtgccagcagtttccttagcgggacagatacgcagtatttt

SEQ ID NO: 568 - DNA, 39 bp, Homo sapiens
tgtgccagcagtttccagggatacactgaagctttcttt

SEQ ID NO: 569 - DNA, 42 bp, Homo sapiens
tgtgccagcagtttttcgacagacggcactgaagctttcttt

SEQ ID NO: 570 - DNA, 42 bp, Homo sapiens
tgtgccagcagttttagtactagtggaaacaccatatatttt

SEQ ID NO: 571 - DNA, 45 bp, Homo sapiens
tgtgccagcagtttctacagcacgaacaccggggagctgtttttt

SEQ ID NO: 572 - DNA, 39 bp, Homo sapiens
tgtgccagcagcggactagcgggaggtgagcagttcttc

SEQ ID NO: 573 - DNA, 33 bp, Homo sapiens
tgtgccagcagtatcctcactgaagctttcttt

SEQ ID NO: 574 - DNA, 33 bp, Homo sapiens
tgtgccagcagtctggcggatacgcagtatttt

SEQ ID NO: 575 - DNA, 45 bp, Homo sapiens
tgtgccagcagtctagaacaggggggcaatgaaaaactgtttttt

SEQ ID NO: 576 - DNA, 48 bp, Homo sapiens
tgtgccagcagtttagagtggactgggggggtttatgagcagttcttc

SEQ ID NO: 577 - DNA, 48 bp, Homo sapiens
tgtgccagcagtttattttgggagaccgcacaagagacccagtacttc

SEQ ID NO: 578 - DNA, 39 bp, Homo sapiens
tgtgccagcagtttattacagggaaacattcagtacttc

SEQ ID NO: 579 - DNA, 42 bp, Homo sapiens
tgtgccagcagtttattgacagggaggactgaagctttcttt

SEQ ID NO: 580 - DNA, 42 bp, Homo sapiens
tgtgccagcagtctaccgacaggggaacagccccagcatttt

SEQ ID NO: 581 - DNA, 42 bp, Homo sapiens
tgtgccagcagtttacggggaagcaaccagccccagcatttt

SEQ ID NO: 582 - DNA, 54 bp, Homo sapiens
tgtgccagcagtttatcgggactagcgggctggtccgacaatgagcagttcttc

SEQ ID NO: 583 - DNA, 42 bp, Homo sapiens
tgtgccagcagtttatctagcgggagatacgagcagtacttc

SEQ ID NO: 584 - DNA, 45 bp, Homo sapiens
tgtgccagcagtttagttccagggaggaacactgaagctttcttt

SEQ ID NO: 585 - DNA, 36 bp, Homo sapiens
tgtgccagcagtttatatgggggggagctgtttttt

SEQ ID NO: 586 - DNA, 45 bp, Homo sapiens
tgtgccagcagtccgggggcaaacggggcggacaccatatatttt

SEQ ID NO: 587 - DNA, 33 bp, Homo sapiens
tgtgccagcagtcctggacctgaagctttcttt

SEQ ID NO: 588 - DNA, 48 bp, Homo sapiens
tgtgccagcagtccgccctggcgtccacaaacagatacgcagtatttt

SEQ ID NO: 589 - DNA, 45 bp, Homo sapiens
tgtgccagcagtccatcccctgcaggggcctatggctacaccttc

SEQ ID NO: 590 - DNA, 42 bp, Homo sapiens
tgtgccagcagtcgacagttacttaatgaaaaactgtttttt

SEQ ID NO: 591 - DNA, 42 bp, Homo sapiens
tgtgccagcagccgaagcggggcctcctacgagcagtacttc

SEQ ID NO: 592 - DNA, 33 bp, Homo sapiens
tgtgccagcagttctctgggggagcagtacttc

SEQ ID NO: 593 - DNA, 36 bp, Homo sapiens
tgtgccagcagttccctgacctacgagcagtacttc

SEQ ID NO: 594 - DNA, 42 bp, Homo sapiens
tgtgccagcagttcccaggacagctcctacgagcagtacttc

SEQ ID NO: 595 - DNA, 36 bp, Homo sapiens
tgtgccagcagttcctcggggaccgagcagtacttc

SEQ ID NO: 596 - DNA, 36 bp, Homo sapiens
tgtgccagcagctcgacagcaattgagcagttcttc

SEQ ID NO: 597 - DNA, 45 bp, Homo sapiens
tgtgccagcagtaccctggttgggggcgccgctgaagctttcttt

SEQ ID NO: 598 - DNA, 33 bp, Homo sapiens
tgtgccagctcgacctacaatgagcagttcttc

SEQ ID NO: 599 - DNA, 48 bp, Homo sapiens
tgtgccagcagtgtatccgggactagcgggaggaatgagcagttcttc

SEQ ID NO: 600 - DNA, 45 bp, Homo sapiens
tgtgccagcagttacctggatgcaggaaattcacccctccacttt

SEQ ID NO: 601 - DNA, 45 bp, Homo sapiens
tgtgccagcagctacctctccgacggaacctacgagcagtacttc

SEQ ID NO: 602 - DNA, 36 bp, Homo sapiens
tgtgccagcaccgcccctcgagggccccagcatttt

SEQ ID NO: 603 - DNA, 48 bp, Homo sapiens
tgtgccagcactattacggcgggacaggtaaactacgagcagtacttc

SEQ ID NO: 604 - DNA, 42 bp, Homo sapiens
tgtgccagcaccctcagggtgggagtcggggagctgtttttt

SEQ ID NO: 605 - DNA, 51 bp, Homo sapiens
tgtgccacgaaacagggggccaggactagcgacaccggggagctgtttttt

SEQ ID NO: 606 - DNA, 42 bp, Homo sapiens
tgtgccgtccagggcgggagtggcaccggggagctgtttttt

SEQ ID NO: 607 - DNA, 39 bp, Homo sapiens
tgcagcgctgggactagcagtaccggggagctgtttttt

SEQ ID NO: 608 - DNA, 30 bp, Homo sapiens
tgcagcgcccacgaagagacccagtacttc

SEQ ID NO: 609 - DNA, 45 bp, Homo sapiens
tgcagcgctagctttgagacagagctcaatcagccccagcatttt

SEQ ID NO: 610 - DNA, 39 bp, Homo sapiens
tgcagctctataggggagctcctggatggctacaccttc

SEQ ID NO: 611 - DNA, 42 bp, Homo sapiens
tgcagcgttgattgggtgagggagcaagagacccagtacttc

SEQ ID NO: 612 - DNA, 45 bp, Homo sapiens
tgcagcgttgaagctagcgggtgggggaaggatacgcagtatttt

SEQ ID NO: 613 - DNA, 45 bp, Homo sapiens
tgcagcgttgaagacgaactagcgggggggcatgagcagttcttc

SEQ ID NO: 614 - DNA, 39 bp, Homo sapiens
tgcagcgttgaagaatttacggacactgaagctttcttt

SEQ ID NO: 615 - DNA, 36 bp, Homo sapiens
tgcagcgttgagcaggacacatatggctacaccttc

SEQ ID NO: 616 - DNA, 42 bp, Homo sapiens
tgcagcgttgagagggcttggaaacaaactgaagctttcttt

SEQ ID NO: 617 - DNA, 33 bp, Homo sapiens
tgcagcgttgaatcggcgaatggctacaccttc

SEQ ID NO: 618 - DNA, 33 bp, Homo sapiens
tgcagcgttgaatcctacaatgagcagttcttc

SEQ ID NO: 619 - DNA, 48 bp, Homo sapiens
tgcagcgttgaagtcccattggtgttggactacaatgagcagttcttc

SEQ ID NO: 620 - DNA, 36 bp, Homo sapiens
tgcagcgttgaggtcagactcaatgagcagttcttc

SEQ ID NO: 621 - DNA, 39 bp, Homo sapiens
tgcagcgttggggcgccggggtcagatacgcagtatttt

SEQ ID NO: 622 - DNA, 51 bp, Homo sapiens
tgcagcgtgaatacagggacaggacatccctcgggacatggctacaccttc

SEQ ID NO: 623 - DNA, 39 bp, Homo sapiens
tgcagcgtcccgtctcgtatgaacactgaagctttcttt

SEQ ID NO: 624 - DNA, 45 bp, Homo sapiens
tgtgcctggagtgtaggtttcttagcgggatacgagcagtacttc

SEQ ID NO: 625 - DNA, 36 bp, Homo sapiens
tgtgcctggagtgtactgtcggatgagcagttcttc

SEQ ID NO: 626 - DNA, 45 bp, Homo sapiens
tgtgcctggagtccccccgggactctaacctacgagcagtacttc

SEQ ID NO: 627 - DNA, 48 bp, Homo sapiens
tgtgcctggcaaacaagagccaggggcaggaattcacccctccacttt

SEQ ID NO: 628 - DNA, 48 bp, Homo sapiens
tgtgcctggagacccccgggacaggggcccggaaacaccatatatttt

SEQ ID NO: 629 - DNA, 36 bp, Homo sapiens
tgtgcctggagtgtcgggaacactgaagctttcttt

SEQ ID NO: 630 - DNA, 39 bp, Homo sapiens
tgtgcctggagtacaggcaatgaagagacccagtacttc

SEQ ID NO: 631 - DNA, 42 bp, Homo sapiens
tgtgcctggaccccggggagggggcgtgaaaaactgtttttt

SEQ ID NO: 632 - DNA, 33 bp, Homo sapiens
tgtgcctggagtgcggctactgaagctttcttt

SEQ ID NO: 633 - DNA, 42 bp, Homo sapiens
tgtgcctggagtcgaggagcagggtccaatgaagctttcttt

SEQ ID NO: 634 - DNA, 39 bp, Homo sapiens
tgtgcctggagtgtcttcgggggcactgaagctttcttt

SEQ ID NO: 635 - DNA, 42 bp, Homo sapiens
tgtgcctggagtgtaggggaggccgcctacgagcagtacttc

SEQ ID NO: 636 - DNA, 36 bp, Homo sapiens
tgtgcctggaagggtgagggtgctgagcagttcttc

SEQ ID NO: 637 - DNA, 36 bp, Homo sapiens
tgtgccagcgggaagctggggcagccccagcatttt

SEQ ID NO: 638 - DNA, 48 bp, Homo sapiens
tgtgccagtaagggactagcgggagtgaaggcgggtgagcagtacttc

SEQ ID NO: 639 - DNA, 39 bp, Homo sapiens
tgtgccagcagggatttctcagaagatgagcagttcttc

SEQ ID NO: 640 - DNA, 45 bp, Homo sapiens
tgtgccagtaggggccttttggggagcaatcagccccagcatttt

SEQ ID NO: 641 - DNA, 45 bp, Homo sapiens
tgtgccagcagtgagatggtgactagccgggagacccagtacttc

SEQ ID NO: 642 - DNA, 36 bp, Homo sapiens
tgcgccagcagtggcggaggcggggagctgtttttt

SEQ ID NO: 643 - DNA, 51 bp, Homo sapiens
tgtgccagtagtataaaggggtcggctagcggcttcaatgagcagttcttc

SEQ ID NO: 644 - DNA, 51 bp, Homo sapiens
tgtgccagcagcaagatagtagggggaccgatctcttcacccctccacttt

SEQ ID NO: 645 - DNA, 42 bp, Homo sapiens
tgtgccagcagccaagacccgggggactacgagcagtacttc

SEQ ID NO: 646 - DNA, 42 bp, Homo sapiens; identical to SEQ ID NO: 645

SEQ ID NO: 647 - DNA, 45 bp, Homo sapiens
tgtgccagcagctccactagcggacctacctacgagcagtacttc

SEQ ID NO: 648 - DNA, 45 bp, Homo sapiens
tgtgccagcagctacttcgaacaggggtccagggagctgtttttt

SEQ ID NO: 649 - DNA, 39 bp, Homo sapiens
tgtgccagcagttatgggggggttgaggggcagtatttt

SEQ ID NO: 650 - DNA, 39 bp, Homo sapiens; identical to SEQ ID NO: 649

SEQ ID NO: 651 - DNA, 39 bp, Homo sapiens; identical to SEQ ID NO: 649

SEQ ID NO: 652 - DNA, 39 bp, Homo sapiens; identical to SEQ ID NO: 649

SEQ ID NO: 653 - DNA, 39 bp, Homo sapiens; identical to SEQ ID NO: 649

SEQ ID NO: 654 - DNA, 39 bp, Homo sapiens; identical to SEQ ID NO: 649

SEQ ID NO: 655 - DNA, 39 bp, Homo sapiens; identical to SEQ ID NO: 649

SEQ ID NO: 656 - DNA, 39 bp, Homo sapiens; identical to SEQ ID NO: 649

SEQ ID NO: 657 - DNA, 39 bp, Homo sapiens; identical to SEQ ID NO: 649

SEQ ID NO: 658 - DNA, 39 bp, Homo sapiens; identical to SEQ ID NO: 649

SEQ ID NO: 659 - DNA, 39 bp, Homo sapiens; identical to SEQ ID NO: 649

SEQ ID NO: 660 - DNA, 39 bp, Homo sapiens; identical to SEQ ID NO: 649

SEQ ID NO: 661 - DNA, 39 bp, Homo sapiens; identical to SEQ ID NO: 649

SEQ ID NO: 662 - DNA, 39 bp, Homo sapiens; identical to SEQ ID NO: 649

SEQ ID NO: 663 - DNA, 39 bp, Homo sapiens; identical to SEQ ID NO: 649

SEQ ID NO: 664 - DNA, 39 bp, Homo sapiens; identical to SEQ ID NO: 649

SEQ ID NO: 665 - DNA, 39 bp, Homo sapiens; identical to SEQ ID NO: 649

SEQ ID NO: 666 - DNA, 39 bp, Homo sapiens; identical to SEQ ID NO: 649

SEQ ID NO: 667 - DNA, 42 bp, Homo sapiens
tgtgccagcagttactacgacgaaacctacgagcagtacttc

SEQ ID NO: 668 - DNA, 42 bp, Homo sapiens; identical to SEQ ID NO: 667

SEQ ID NO: 669 - DNA, 33 bp, Homo sapiens
tgtgccagtacgcgcggagatacgcagtatttt

SEQ ID NO: 670 - DNA, 45 bp, Homo sapiens
tgtgccaccagcaatttaaggcaacccgaacaaccccagcatttt

SEQ ID NO: 671 - DNA, 39 bp, Homo sapiens
ggggccaccagttatgggggggtggaggggaagaatttt

SEQ ID NO: 672 - DNA, 48 bp, Homo sapiens
tgtgccatcagtacgacagaacgtagctcctacaatgagcagttcttc

SEQ ID NO: 673 - DNA, 51 bp, Homo sapiens
tgtgccagcaaacccgggggtcgggacaggggagtcggttccctccacttt

SEQ ID NO: 674 - DNA, 45 bp, Homo sapiens
tgcgccagcagtgatcgtggcgcaggtaatcagccccagcatttt

SEQ ID NO: 675 - DNA, 42 bp, Homo sapiens
tgtgccagtagcgaccggggcggggtcaacgagcagtacttc

SEQ ID NO: 676 - DNA, 42 bp, Homo sapiens
tgtgccagcagtgagatagagacctacaatgagcagttcttc

SEQ ID NO: 677 - DNA, 42 bp, Homo sapiens
tgtgccagcagctttcaggggcgggcctatggctacaccttc

SEQ ID NO: 678 - DNA, 45 bp, Homo sapiens
tgtgccagcagcggccgggaggacggttacaatgagcagttcttc

SEQ ID NO: 679 - DNA, 42 bp, Homo sapiens
tgtgccagttccgggactagcgtttacaatgagcagttcttc

SEQ ID NO: 680 - DNA, 48 bp, Homo sapiens
tgtgccagcagtggttatagcgggagagtctacaatgagcagttcttc

SEQ ID NO: 681 - DNA, 42 bp, Homo sapiens
tgtgccagtagtattgggccagggtgggagccccagcatttt

SEQ ID NO: 682 - DNA, 45 bp, Homo sapiens
tgtgccagtagtatcggacagggggccacagatacgcagtatttt

SEQ ID NO: 683 - DNA, 42 bp, Homo sapiens
tgtgccagtagtatttctgcttacctctacgagcagtacttc

SEQ ID NO: 684 - DNA, 45 bp, Homo sapiens
tgtgccagtagtataaccgggacagggggtcctggctacaccttc

SEQ ID NO: 685 - DNA, 45 bp, Homo sapiens
tgtgccagcagtttagctgctggaaactcctacgagcagtacttc

SEQ ID NO: 686 - DNA, 42 bp, Homo sapiens
tgtgccagcagcttagctttcgggacagatacgcagtatttt

SEQ ID NO: 687 - DNA, 48 bp, Homo sapiens
tgtgccagcagcttagatttcactgagccgggtagcgagcagtacttc

SEQ ID NO: 688 - DNA, 42 bp, Homo sapiens
tgtgccagcagcctagggttggggaccggggagctgtttttt

SEQ ID NO: 689 - DNA, 42 bp, Homo sapiens
tgcgccagcagcttggggacaccgaacactgaagctttcttt

SEQ ID NO: 690 - DNA, 42 bp, Homo sapiens
tgtgccagcagcttagggtatggagaagagacccagtacttc

SEQ ID NO: 691 - DNA, 42 bp, Homo sapiens
tgtgccagctccctacagggcgggggagagacccagtacttc

SEQ ID NO: 692 - DNA, 39 bp, Homo sapiens
tgtgccagcagtttatcgggaaccggggagctgtttttt

SEQ ID NO: 693 - DNA, 39 bp, Homo sapiens; identical to SEQ ID NO: 692

SEQ ID NO: 694 - DNA, 39 bp, Homo sapiens; identical to SEQ ID NO: 692

SEQ ID NO: 695 - DNA, 39 bp, Homo sapiens; identical to SEQ ID NO: 692

SEQ ID NO: 696 - DNA, 39 bp, Homo sapiens; identical to SEQ ID NO: 692

SEQ ID NO: 697 - DNA, 39 bp, Homo sapiens; identical to SEQ ID NO: 692

SEQ ID NO: 698 - DNA, 39 bp, Homo sapiens; identical to SEQ ID NO: 692

SEQ ID NO: 699 - DNA, 39 bp, Homo sapiens; identical to SEQ ID NO: 692

SEQ ID NO: 700 - DNA, 39 bp, Homo sapiens; identical to SEQ ID NO: 692

SEQ ID NO: 701 - DNA, 39 bp, Homo sapiens; identical to SEQ ID NO: 692

SEQ ID NO: 702 - DNA, 39 bp, Homo sapiens; identical to SEQ ID NO: 692

SEQ ID NO: 703 - DNA, 39 bp, Homo sapiens; identical to SEQ ID NO: 692

SEQ ID NO: 704 - DNA, 39 bp, Homo sapiens; identical to SEQ ID NO: 692

SEQ ID NO: 705 - DNA, 39 bp, Homo sapiens; identical to SEQ ID NO: 692

SEQ ID NO: 706 - DNA, 39 bp, Homo sapiens; identical to SEQ ID NO: 692

SEQ ID NO: 707 - DNA, 39 bp, Homo sapiens; identical to SEQ ID NO: 692

SEQ ID NO: 708 - DNA, 39 bp, Homo sapiens; identical to SEQ ID NO: 692

SEQ ID NO: 709 - DNA, 39 bp, Homo sapiens; identical to SEQ ID NO: 692

SEQ ID NO: 710 - DNA, 39 bp, Homo sapiens; identical to SEQ ID NO: 692

SEQ ID NO: 711 - DNA, 39 bp, Homo sapiens; identical to SEQ ID NO: 692

SEQ ID NO: 712 - DNA, 39 bp, Homo sapiens; identical to SEQ ID NO: 692

SEQ ID NO: 713 - DNA, 39 bp, Homo sapiens; identical to SEQ ID NO: 692

SEQ ID NO: 714 - DNA, 39 bp, Homo sapiens; identical to SEQ ID NO: 692

SEQ ID NO: 715 - DNA, 39 bp, Homo sapiens; identical to SEQ ID NO: 692

SEQ ID NO: 716 - DNA, 39 bp, Homo sapiens; identical to SEQ ID NO: 692

SEQ ID NO: 717 - DNA, 39 bp, Homo sapiens; identical to SEQ ID NO: 692

SEQ ID NO: 718 - DNA, 39 bp, Homo sapiens; identical to SEQ ID NO: 692

SEQ ID NO: 719 - DNA, 39 bp, Homo sapiens; identical to SEQ ID NO: 692

SEQ ID NO: 720 - DNA, 39 bp, Homo sapiens; identical to SEQ ID NO: 692

SEQ ID NO: 721 - DNA, 39 bp, Homo sapiens; identical to SEQ ID NO: 692

SEQ ID NO: 722 - DNA, 39 bp, Homo sapiens; identical to SEQ ID NO: 692

SEQ ID NO: 723 - DNA, 39 bp, Homo sapiens; identical to SEQ ID NO: 692

SEQ ID NO: 724 - DNA, 39 bp, Homo sapiens; identical to SEQ ID NO: 692

SEQ ID NO: 725 - DNA, 39 bp, Homo sapiens; identical to SEQ ID NO: 692

SEQ ID NO: 726 - DNA, 39 bp, Homo sapiens; identical to SEQ ID NO: 692

SEQ ID NO: 727 - DNA, 39 bp, Homo sapiens; identical to SEQ ID NO: 692

SEQ ID NO: 728 - DNA, 39 bp, Homo sapiens; identical to SEQ ID NO: 692

SEQ ID NO: 729 - DNA, 39 bp, Homo sapiens; identical to SEQ ID NO: 692

SEQ ID NO: 730 - DNA, 39 bp, Homo sapiens; identical to SEQ ID NO: 692

SEQ ID NO: 731 - DNA, 48 bp, Homo sapiens
tgtgccagcagtctatcacaggggggtaacacagatacgcagtatttt

SEQ ID NO: 732 - DNA, 48 bp, Homo sapiens
tgtgccagcagcttaaccggcaggggtctggactatggctacaccttc

SEQ ID NO: 733 - DNA, 39 bp, Homo sapiens
tgcgccagcagcttgtatgggaccactgaagctttcttt

SEQ ID NO: 734 - DNA, 39 bp, Homo sapiens
tgtgccagcagcccgggacacgcggatggctacaccttc

SEQ ID NO: 735 - DNA, 54 bp, Homo sapiens
tgtgccagcagtcctcggggggacaacctggatgggagctatggctacaccttc

SEQ ID NO: 736 - DNA, 45 bp, Homo sapiens
tgtgccagcagccctacttctagctcctacaatgagcagttcttc

SEQ ID NO: 737 - DNA, 45 bp, Homo sapiens
tgtgccagcagtagggggagcctagcgggagagacccagtacttc

SEQ ID NO: 738 - DNA, 36 bp, Homo sapiens
tgtgccagcagttcggaggatcagccccagcatttt

SEQ ID NO: 739 - DNA, 33 bp, Homo sapiens
tgtgccagcagttccggacaagagcagttcttc

SEQ ID NO: 740 - DNA, 42 bp, Homo sapiens
tgtgccagcagcgtagggggcagtacctacgagcagtacttc

SEQ ID NO: 741 - DNA, 45 bp, Homo sapiens
tgtgccagcacaaacggaggacaggggcaagagacccagtacttc

SEQ ID NO: 742 - DNA, 45 bp, Homo sapiens
tgtgccagcactcaagcggggcagggggccaatgagcagttcttc

SEQ ID NO: 743 - DNA, 45 bp, Homo sapiens
tgtgccaccagtgaaggaaggggaggcaatcagccccagcatttt

SEQ ID NO: 744 - DNA, 45 bp, Homo sapiens; identical to SEQ ID NO: 743

SEQ ID NO: 745 - DNA, 45 bp, Homo sapiens; identical to SEQ ID NO: 743

SEQ ID NO: 746 - DNA, 45 bp, Homo sapiens; identical to SEQ ID NO: 743

SEQ ID NO: 747 - DNA, 45 bp, Homo sapiens; identical to SEQ ID NO: 743

SEQ ID NO: 748 - DNA, 45 bp, Homo sapiens; identical to SEQ ID NO: 743

SEQ ID NO: 749 - DNA, 45 bp, Homo sapiens; identical to SEQ ID NO: 743

SEQ ID NO: 750 - DNA, 45 bp, Homo sapiens; identical to SEQ ID NO: 743

SEQ ID NO: 751 - DNA, 48 bp, Homo sapiens
tgtgccaccagcagagacccgggacagggggcagatacgcagtatttt

SEQ ID NO: 752 - DNA, 45 bp, Homo sapiens
tgtgcctggagccggacagggggcgttaatgaaaaactgtttttt

SEQ ID NO: 753 - DNA, 39 bp, Homo sapiens
tgcagtgctactcgaatggggaccggggggcagtacttc

SEQ ID NO: 754 - DNA, 39 bp, Homo sapiens
tgcagtttaaagggttcaggggagactgaagctttcttt

SEQ ID NO: 755 - DNA, 39 bp, Homo sapiens
tgctcagtggcacaccacctctcctacgagcagtacttc

SEQ ID NO: 756 - DNA, 39 bp, Homo sapiens
tgcagcgttgtcaggggaaatacctacgagcagtacttc

SEQ ID NO: 757 - protein, 15 aa, Homo sapiens
CASKPGTTRNNEQFF

SEQ ID NO: 758 - protein, 11 aa, Homo sapiens
CASMDGSEQFF

SEQ ID NO: 759 - protein, 15 aa, Homo sapiens
CASPPLNRGENEQFF

SEQ ID NO: 760 - protein, 16 aa, Homo sapiens
CASQNLAGPQYNEQFF

SEQ ID NO: 761 - protein, 12 aa, Homo sapiens
CASRDRRNTIYF

SEQ ID NO: 762 - protein, 12 aa, Homo sapiens
CASRGEGLEAFF

SEQ ID NO: 763 - protein, 14 aa, Homo sapiens
CASRGQQNFYGYTF

SEQ ID NO: 764 - protein, 15 aa, Homo sapiens
CASSAGQVFPGELFF

SEQ ID NO: 765 - protein, 14 aa, Homo sapiens
CASSARLNVETQYF

SEQ ID NO: 766 - protein, 15 aa, Homo sapiens
CASSDAAATNYEQYF

SEQ ID NO: 767 - protein, 15 aa, Homo sapiens
CASSDGGGAQETQYF

SEQ ID NO: 768 - protein, 15 aa, Homo sapiens
CASSDGGGASETQYF

SEQ ID NO: 769 - protein, 16 aa, Homo sapiens
CASSEAHWDRQETQYF

SEQ ID NO: 770 - protein, 15 aa, Homo sapiens
CASSEALMTFYEQYF

SEQ ID NO: 771 - protein, 16 aa, Homo sapiens
CASSEDRQRTDETQYF

SEQ ID NO: 772 - protein, 15 aa, Homo sapiens
CASSEGGGAQETQYF

SEQ ID NO: 773 - protein, 15 aa, Homo sapiens
CASSEGGGGQETQYF

SEQ ID NO: 774 - protein, 15 aa, Homo sapiens
CASSEGGGLAETQYF

SEQ ID NO: 775 - protein, 15 aa, Homo sapiens
CASSEGHPSQYEQYF

SEQ ID NO: 776 - protein, 15 aa, Homo sapiens
CASSETGSSTDTQYF

SEQ ID NO: 777 - protein, 14 aa, Homo sapiens
CASSEWQGNSPLHF

SEQ ID NO: 778 - protein, 15 aa, Homo sapiens
CASSEWTGDTGELFF

SEQ ID NO: 779 - protein, 14 aa, Homo sapiens
CASSIGTLNTEAFF

SEQ ID NO: 780 - protein, 12 aa, Homo sapiens
CASSLVGEVSLF

SEQ ID NO: 781 - protein, 13 aa, Homo sapiens
CASSPGVSQPQHF

SEQ ID NO: 782 - protein, 13 aa, Homo sapiens
CASSTGLREKLFF

SEQ ID NO: 783 - protein, 17 aa, Homo sapiens
CASSVPDGTGGDNGYTF

SEQ ID NO: 784 - protein, 15 aa, Homo sapiens
CASSWVGDYQETQYF

SEQ ID NO: 785 - protein, 14 aa, Homo sapiens
CATGTSGYRETQYF

SEQ ID NO: 786 - protein, 15 aa, Homo sapiens
CATGWGDSSTDTQYF

SEQ ID NO: 787 - protein, 17 aa, Homo sapiens
CATHEASGKWGQETQYF

SEQ ID NO: 788 - protein, 15 aa, Homo sapiens
CDLNETFRRPYEQYF

SEQ ID NO: 789 - protein, 13 aa, Homo sapiens
CASRSLAGGEQFF

SEQ ID NO: 790 - protein, 14 aa, Homo sapiens
CASSGRPGGEKLFF

SEQ ID NO: 791 - protein, 17 aa, Homo sapiens
CASSLALAGGISYEQYF

SEQ ID NO: 792 - protein, 15 aa, Homo sapiens
CASSLDSASYNEQFF

SEQ ID NO: 793 - protein, 16 aa, Homo sapiens
CASSPFRGEIVETQYF

SEQ ID NO: 794 - protein, 14 aa, Homo sapiens
CASSPIDKPGELFF

SEQ ID NO: 795 - protein, 14 aa, Homo sapiens
CASSPPPGGEKLFF

SEQ ID NO: 796 - protein, 15 aa, Homo sapiens
CASSPRAGAGGELFF

SEQ ID NO: 797 - protein, 15 aa, Homo sapiens
CASSQELSPPYEQYF

SEQ ID NO: 798 - protein, 16 aa, Homo sapiens
CASSQLDRTNTGELFF

SEQ ID NO: 799 - protein, 16 aa, Homo sapiens
CASSQLETTRKGKLFF

SEQ ID NO: 800 - protein, 13 aa, Homo sapiens
CASSQLGDFGYTF

SEQ ID NO: 801 - protein, 18 aa, Homo sapiens
CASSQSSLAGGPSGELFF

SEQ ID NO: 802 - protein, 17 aa, Homo sapiens
CASSQTGSPQITDTQYF

SEQ ID NO: 803 - protein, 20 aa, Homo sapiens
CASSQVGREVSGRALDEQFF

SEQ ID NO: 804 - protein, 14 aa, Homo sapiens
CASSQWVGGTEAFF

SEQ ID NO: 805 - protein, 15 aa, Homo sapiens
CASSSRAGAGGEQFF

SEQ ID NO: 806 - protein, 14 aa, Homo sapiens
CASTRGGGGSEAFF

SEQ ID NO: 807 - protein, 13 aa, Homo sapiens
CASSHSNTGELFF

SEQ ID NO: 808 - protein, 18 aa, Homo sapiens
CASSLTQAGQSPAYEQYF

SEQ ID NO: 809 - protein, 16 aa, Homo sapiens
CASSPQLAERSYEQYF

SEQ ID NO: 810 - protein, 13 aa, Homo sapiens
CASSQALSYEQYF

SEQ ID NO: 811 - protein, 12 aa, Homo sapiens
CASSQDGYEQYF

SEQ ID NO: 812 - protein, 14 aa, Homo sapiens
CASSQDQGIIEAFF

SEQ ID NO: 813 - protein, 19 aa, Homo sapiens
CASSQDQQGVMVLAQPQHF

SEQ ID NO: 814 - protein, 13 aa, Homo sapiens
CASSQDRSNEQFF

SEQ ID NO: 815 - protein, 16 aa, Homo sapiens
CASSQDWPGSSYEQYF

SEQ ID NO: 816 - protein, 16 aa, Homo sapiens
CASSQEAGLLYNEQFF

SEQ ID NO: 817 - protein, 15 aa, Homo sapiens
CASSQEANRGEVQYF

SEQ ID NO: 818 - protein, 14 aa, Homo sapiens
CASSQEGFNQPQHF

SEQ ID NO: 819 - protein, 14 aa, Homo sapiens
CASSQESLNTEAFF

SEQ ID NO: 820 - protein, 15 aa, Homo sapiens
CASSQGAAGANVLTF

SEQ ID NO: 821 - protein, 12 aa, Homo sapiens
CASSQGGREQYF

SEQ ID NO: 822 - protein, 16 aa, Homo sapiens
CASSQVLSRGYGEQFF

SEQ ID NO: 823 - protein, 15 aa, Homo sapiens
CASSQVQGGGTEAFF

SEQ ID NO: 824 - protein, 14 aa, Homo sapiens
CASSSSGTTGELFF

SEQ ID NO: 825 - protein, 16 aa, Homo sapiens
CASSHERERNTGELFF

SEQ ID NO: 826 - protein, 15 aa, Homo sapiens
CASSQDGGDTDTQYF

SEQ ID NO: 827 - protein, 14 aa, Homo sapiens
CASSQDPAYYGYTF

SEQ ID NO: 828 - protein, 14 aa, Homo sapiens
CASSQEVGWETQYF

SEQ ID NO: 829 - protein, 16 aa, Homo sapiens
CASSQGWQARGSPLHF

SEQ ID NO: 830 - protein, 15 aa, Homo sapiens
CASSQSMTSAETQYF

SEQ ID NO: 831 - protein, 14 aa, Homo sapiens
CASSPTPRPGELFF

SEQ ID NO: 832 - protein, 15 aa, Homo sapiens
CASSQDGTGSYEQYF

SEQ ID NO: 833 - protein, 15 aa, Homo sapiens
CASSQDLTSGDEQFF

SEQ ID NO: 834 - protein, 17 aa, Homo sapiens
CASSQDRRGVGWTEAFF

SEQ ID NO: 835 - protein, 18 aa, Homo sapiens
CASSENKIGVAVSYEQYF

SEQ ID NO: 836 - protein, 16 aa, Homo sapiens
CASSERQGNIYSEQYF

SEQ ID NO: 837 - protein, 12 aa, Homo sapiens
CASSFIEGEQFF

SEQ ID NO: 838 - protein, 16 aa, Homo sapiens
CASSFMSGSLGNEQFF

SEQ ID NO: 839 - protein, 15 aa, Homo sapiens
CASSFSGSGNIEQFF

SEQ ID NO: 840 - protein, 14 aa, Homo sapiens
CASSGGLSGDEQFF

SEQ ID NO: 841 - protein, 15 aa, Homo sapiens
CASSLATGQVGEQYF

SEQ ID NO: 842 - protein, 17 aa, Homo sapiens
CASSLDRETLSGNTIYF

SEQ ID NO: 843 - protein, 19 aa, Homo sapiens
CASSLGPSLLAEVGNEQFF

SEQ ID NO: 844 - protein, 16 aa, Homo sapiens
CASSLVVRGGQETQYF

SEQ ID NO: 845 - protein, 17 aa, Homo sapiens
CASSLYLWGEGQNEQFF

SEQ ID NO: 846 - protein, 15 aa, Homo sapiens
CASSPTAGTRYEQYF

SEQ ID NO: 847 - protein, 14 aa, Homo sapiens
CASSSDGSGYGYTF

SEQ ID NO: 848 - protein, 14 aa, Homo sapiens
CASSYTDSNTEAFF

SEQ ID NO: 849 - protein, 13 aa, Homo sapiens
CASQGLAGDTQYF

SEQ ID NO: 850 - protein, 15 aa, Homo sapiens
CASRQTGLLTDTQYF

SEQ ID NO: 851 - protein, 15 aa, Homo sapiens
CASSFSGGHPMGYTF

SEQ ID NO: 852 - protein, 14 aa, Homo sapiens
CASSLELAGDEQYF

SEQ ID NO: 853 - protein, 16 aa, Homo sapiens
CASSLGARGWGNEQFF

SEQ ID NO: 854 - protein, 13 aa, Homo sapiens
CASSLGGQREAFF

SEQ ID NO: 855 - protein, 15 aa, Homo sapiens
CASSLGLAGKNEQYF

SEQ ID NO: 856 - protein, 16 aa, Homo sapiens
CASSLGSGGPFDEQFF

SEQ ID NO: 857 - protein, 15 aa, Homo sapiens
CASSLTSGSLNEQYF

SEQ ID NO: 858 - protein, 17 aa, Homo sapiens
CASSSDLRWEGDTEAFF

SEQ ID NO: 859 - protein, 16 aa, Homo sapiens
CASSLELAGGRDTQYF

SEQ ID NO: 860 - protein, 17 aa, Homo sapiens
CASSPELAGGLLETQYF

SEQ ID NO: 861 - protein, 17 aa, Homo sapiens
CASSPRSPGTSGDEQYF

SEQ ID NO: 862 - protein, 13 aa, Homo sapiens
CASSRERYNEQFF

SEQ ID NO: 863 - protein, 17 aa, Homo sapiens
CASSSKGPQASNEKLFF

SEQ ID NO: 864 - protein, 15 aa, Homo sapiens
CASSEAGTGRETQYF

SEQ ID NO: 865 - protein, 20 aa, Homo sapiens
CASSLAELGRGGRLHYEQYF

SEQ ID NO: 866 - protein, 16 aa, Homo sapiens
CASSLAVQLAKNIQYF

SEQ ID NO: 867 - protein, 14 aa, Homo sapiens
CASSLGASRYEQYF

SEQ ID NO: 868 - protein, 14 aa, Homo sapiens
CASSLGAVLYEQYF

SEQ ID NO: 869 - protein, 14 aa, Homo sapiens
CASSLGGLIYEQYF

SEQ ID NO: 870 - protein, 14 aa, Homo sapiens
CASSLLSRPDTQYF

SEQ ID NO: 871 - protein, 14 aa, Homo sapiens
CASSRLANYNEQFF

SEQ ID NO: 872 - protein, 20 aa, Homo sapiens
CASSSPFSGLAGTYSYEQYF

SEQ ID NO: 873 - protein, 18 aa, Homo sapiens
CASSLAYRHRTAYYEQYF

SEQ ID NO: 874 - protein, 16 aa, Homo sapiens
CASSLEREMNTGELFF

SEQ ID NO: 875 - protein, 14 aa, Homo sapiens
CASTLDGSNNEQFF

SEQ ID NO: 876 - protein, 15 aa, Homo sapiens
CASCDGTRESDIQYF

SEQ ID NO: 877 - protein, 13 aa, Homo sapiens
CASGGFEKYGYTF

SEQ ID NO: 878 - protein, 14 aa, Homo sapiens
CASRSWGYPETQYF

SEQ ID NO: 879 - protein, 15 aa, Homo sapiens
CASSEAAESNQPQHF

SEQ ID NO: 880 - protein, 16 aa, Homo sapiens
CASSEAGQGVRETQYF

SEQ ID NO: 881 - protein, 15 aa, Homo sapiens
CASSEEAGGASGYTF

SEQ ID NO: 882 - protein, 17 aa, Homo sapiens
CASSEEGGTSAYNEQFF

SEQ ID NO: 883 - protein, 15 aa, Homo sapiens
CASSEFGGSNQPQHF

SEQ ID NO: 884 - protein, 15 aa, Homo sapiens
CASSEGAGGLDTQYF

SEQ ID NO: 885 - protein, 14 aa, Homo sapiens
CASSEWSLRDEQFF

SEQ ID NO: 886 - protein, 15 aa, Homo sapiens
CASSSAGTPNYGYTF

SEQ ID NO: 887 - protein, 16 aa, Homo sapiens
CASSTGATGTNEKLFF

SEQ ID NO: 888 - protein, 15 aa, Homo sapiens
CASTEPPDRATEAFF

SEQ ID NO: 889 - protein, 13 aa, Homo sapiens
CASSFSVAYEQYF

SEQ ID NO: 890 - protein, 15 aa, Homo sapiens
CASSLETLNTGELFF

SEQ ID NO: 891 - protein, 16 aa, Homo sapiens
CASSPDSGKNTGELFF

SEQ ID NO: 892 - protein, 14 aa, Homo sapiens
CASSQAGESDTQYF

SEQ ID NO: 893 - protein, 14 aa, Homo sapiens
CASSSGLATDTQYF

SEQ ID NO: 894 - protein, 13 aa, Homo sapiens
CASSWGADNEQFF

SEQ ID NO: 895 - protein, 15 aa, Homo sapiens
CASSWSVLSTDTQYF

SEQ ID NO: 896 - protein, 15 aa, Homo sapiens
CASSYGLAGSYEQYF

SEQ ID NO: 897 - protein, 14 aa, Homo sapiens
CASSYLGATNEAFF

SEQ ID NO: 898 - protein, 15 aa, Homo sapiens
CASSYLGATNEKLFF

SEQ ID NO: 899 - protein, 16 aa, Homo sapiens
CASSYSSDRVSDTQYF

SEQ ID NO: 900 - protein, 16 aa, Homo sapiens
CASSYSSRTGQETQYF

SEQ ID NO: 901 - protein, 14 aa, Homo sapiens
CASSYSTNSYEQYF

SEQ ID NO: 902 - protein, 14 aa, Homo sapiens
CASSYSTSAYEQYF

SEQ ID NO: 903 - protein, 16 aa, Homo sapiens
CASTAQGQIISYEQYF

SEQ ID NO: 904 - protein, 13 aa, Homo sapiens
CASTLGQTGELFF

SEQ ID NO: 905 - protein, 13 aa, Homo sapiens
CASLGSGQETQYF

SEQ ID NO: 906 - protein, 12 aa, Homo sapiens
CASRGTGYEQYF

SEQ ID NO: 907 - protein, 14 aa, Homo sapiens
CASRKGQPPDTQYF

SEQ ID NO: 908 - protein, 16 aa, Homo sapiens
CASRLLAGVPSDEQFF

SEQ ID NO: 909 - protein, 13 aa, Homo sapiens
CASSHRAADTQYF

SEQ ID NO: 910 - protein, 13 aa, Homo sapiens
CASSLGAPYEQYF

SEQ ID NO: 911 - protein, 15 aa, Homo sapiens
CASSMGDREDYEQYF

SEQ ID NO: 912 - protein, 13 aa, Homo sapiens
CASSPSGNIEQYF

SEQ ID NO: 913 - protein, 15 aa, Homo sapiens
CASSSPGTGEYEQYF

SEQ ID NO: 914 - protein, 14 aa, Homo sapiens
CASSWGQVITEAFF

SEQ ID NO: 915 - protein, 14 aa, Homo sapiens
CASSYGEENSPLHF

SEQ ID NO: 916 - protein, 11 aa, Homo sapiens
CASSYGETAFF

SEQ ID NO: 917 - protein, 15 aa, Homo sapiens
CASSYGKGLYNEQFF

SEQ ID NO: 918 - protein, 14 aa, Homo sapiens
CASSYGLGQETQYF

SEQ ID NO: 919 - protein, 11 aa, Homo sapiens
CASSYGREAFF

SEQ ID NO: 920 - protein, 16 aa, Homo sapiens
CASSYGWAASGNTIYF

SEQ ID NO: 921 - protein, 15 aa, Homo sapiens
CASSYLDRGLGEQYF

SEQ ID NO: 922 - protein, 14 aa, Homo sapiens
CASSYRDVAYEQYF

SEQ ID NO: 923 - protein, 16 aa, Homo sapiens
CASSYSGTGIFNEQFF

SEQ ID NO: 924 - protein, 14 aa, Homo sapiens
CASSYSGTTDTQYF

SEQ ID NO: 925 - protein, 17 aa, Homo sapiens
CASSYSKGLADSYEQYF

SEQ ID NO: 926 - protein, 14 aa, Homo sapiens
CASSYSSGWQPMDF

SEQ ID NO: 927 - protein, 16 aa, Homo sapiens
CASSYTQGRTNEKLFF

SEQ ID NO: 928 - protein, 14 aa, Homo sapiens
CASNSGGPPIEQFF

SEQ ID NO: 929 - protein, 13 aa, Homo sapiens
CASRYPQDPGQYF

SEQ ID NO: 930 - protein, 15 aa, Homo sapiens
CASSNAAGPQETQYF

SEQ ID NO: 931 - protein, 14 aa, Homo sapiens
CASSSLTGNQPQHF

SEQ ID NO: 932 - protein, 11 aa, Homo sapiens
CASSYGHEQYF

SEQ ID NO: 933 - protein, 15 aa, Homo sapiens
CASSYLGQLTDTQYF

SEQ ID NO: 934 - protein, 14 aa, Homo sapiens
CASSLGAGTGELFF

SEQ ID NO: 935 - protein, 15 aa, Homo sapiens
CASSLPGGSSYEQYF

SEQ ID NO: 936 - protein, 12 aa, Homo sapiens
CASSLRPNEQFF

SEQ ID NO: 937 - protein, 12 aa, Homo sapiens
CASSSFSYEQYF

SEQ ID NO: 938 - protein, 18 aa, Homo sapiens
CASSHGVIWSPDTGELFF

SEQ ID NO: 939 - protein, 18 aa, Homo sapiens
CASSHLYAAGEGKNIQYF

SEQ ID NO: 940 - protein, 17 aa, Homo sapiens
CASSLEGGPVVGSPLHF

SEQ ID NO: 941 - protein, 14 aa, Homo sapiens
CASSLQQGWYEQYF

SEQ ID NO: 942 - protein, 12 aa, Homo sapiens
CASSPGSTEAFF

SEQ ID NO: 943 - protein, 14 aa, Homo sapiens
CASSPQGDWNEQFF

SEQ ID NO: 944 - protein, 13 aa, Homo sapiens
CASSSVPYNEQFF

SEQ ID NO: 945 - protein, 20 aa, Homo sapiens
CASSSWTSGSSESSYNEQFF

SEQ ID NO: 946 - protein, 14 aa, Homo sapiens
CASSLAGGLDTQYF

SEQ ID NO: 947 - protein, 13 aa, Homo sapiens
CASSLDVSYEQYF

SEQ ID NO: 948 - protein, 13 aa, Homo sapiens
CASSLEGLNEQFF

SEQ ID NO: 949 - protein, 13 aa, Homo sapiens
CASSLFTGREPFF

SEQ ID NO: 950 - protein, 16 aa, Homo sapiens
CASSLGGRASSYEQYF

SEQ ID NO: 951 - protein, 17 aa, Homo sapiens
CASSLIPEGVGTDTQYF

SEQ ID NO: 952 - protein, 16 aa, Homo sapiens
CASSLLDGGSYNEQFF

SEQ ID NO: 953 - protein, 14 aa, Homo sapiens
CASSLSAGSAEQYF

SEQ ID NO: 954 - protein, 16 aa, Homo sapiens
CASSLSLGGESSPLHF

SEQ ID NO: 955 - protein, 14 aa, Homo sapiens
CASSLTGMNTEAFF

SEQ ID NO: 956 - protein, 14 aa, Homo sapiens
CASSPGGMDTEAFF

SEQ ID NO: 957 - protein, 12 aa, Homo sapiens
CASSPGGNEQFF

SEQ ID NO: 958 - protein, 15 aa, Homo sapiens
CASSPGLDPYHEQFF

SEQ ID NO: 959 - protein, 15 aa, Homo sapiens
CASSPGLDPYNEQFF

SEQ ID NO: 960 - protein, 15 aa, Homo sapiens
CASSPSGSPANEQFF

SEQ ID NO: 961 - protein, 15 aa, Homo sapiens
CASSSGAGAGYEQYF

SEQ ID NO: 962 - protein, 15 aa, Homo sapiens
CASSSQGTNTGELFF

SEQ ID NO: 963 - protein, 13 aa, Homo sapiens
CASSLGTSDEQFF

SEQ ID NO: 964 - protein, 15 aa, Homo sapiens
CASSPMSTVFSYEQY

SEQ ID NO: 965 - protein, 18 aa, Homo sapiens
CASSQGTSGPGATGELFF

SEQ ID NO: 966 - protein, 13 aa, Homo sapiens
CASSQRRTDTQYF

SEQ ID NO: 967 - protein, 11 aa, Homo sapiens
CASSSGDEQFF

SEQ ID NO: 968 - protein, 12 aa, Homo sapiens
CASSYRTGELFF

SEQ ID NO: 969 - protein, 13 aa, Homo sapiens
CASSPSLGEKLFF

SEQ ID NO: 970 - protein, 15 aa, Homo sapiens
CASSFGTGRSGELFF

SEQ ID NO: 971 - protein, 15 aa, Homo sapiens
CASSLRQGPSYEQYF

SEQ ID NO: 972 - protein, 12 aa, Homo sapiens
CASSPGHTEAFF

SEQ ID NO: 973 - protein, 20 aa, Homo sapiens
CASSPHSPGLAGVSQETQYF

SEQ ID NO: 974 - protein, 16 aa, Homo sapiens
CASSPLAGGPQNEQFF

SEQ ID NO: 975 - protein, 17 aa, Homo sapiens
CASSPPNREHGTGELFF

SEQ ID NO: 976 - protein, 15 aa, Homo sapiens
CASSWGGGANTEAFF

SEQ ID NO: 977 - protein, 13 aa, Homo sapiens
CASRPMGTDTQYF

SEQ ID NO: 978 - protein, 11 aa, Homo sapiens
CASSDAKEQYF

SEQ ID NO: 979 - protein, 15 aa, Homo sapiens
CASSFPLSSLETQYF

SEQ ID NO: 980 - protein, 16 aa, Homo sapiens
CASSFRQGASTGELFF

SEQ ID NO: 981 - protein, 16 aa, Homo sapiens
CASSFSGDPGANVLTF

SEQ ID NO: 982 - protein, 14 aa, Homo sapiens
CASSHRDRNYEQYF

SEQ ID NO: 983 - protein, 14 aa, Homo sapiens
CASSLAFGDNEQFF

SEQ ID NO: 984 - protein, 16 aa, Homo sapiens
CASSLAQGGDTDTQYF

SEQ ID NO: 985 - protein, 14 aa, Homo sapiens
CASSLASGQETQYF

SEQ ID NO: 986 - protein, 16 aa, Homo sapiens
CASSLAVSGSSDEQYF

SEQ ID NO: 987 - protein, 18 aa, Homo sapiens
CASSLDSISYSGANVLTF

SEQ ID NO: 988 - protein, 15 aa, Homo sapiens
CASSLESDSPYEQYF

SEQ ID NO: 989 - protein, 15 aa, Homo sapiens
CASSLGFGLAGDEQF

SEQ ID NO: 990 - protein, 16 aa, Homo sapiens
CASSLGFGREANVLTF

SEQ ID NO: 991 - protein, 14 aa, Homo sapiens
CASSLGFGRETQYF

SEQ ID NO: 992 - protein, 16 aa, Homo sapiens
CASSLGLAGYTGELFF

SEQ ID NO: 993 - protein, 15 aa, Homo sapiens
CASSLGLGPQNPQHF

SEQ ID NO: 994 - protein, 14 aa, Homo sapiens
CASSLGQGEEKLFF

SEQ ID NO: 995 - protein, 14 aa, Homo sapiens
CASSLGTGTDTQYF

SEQ ID NO: 996 - protein, 16 aa, Homo sapiens
CASSLGVGTEGEKLFF

SEQ ID NO: 997 - protein, 15 aa, Homo sapiens
CASSLGWGAKNIQYF

SEQ ID NO: 998 - protein, 14 aa, Homo sapiens
CASSLGYGEETQYF

SEQ ID NO: 999 - protein, 15 aa, Homo sapiens
CASSLGYGEGETQYF

SEQ ID NO: 1000 - protein, 15 aa, Homo sapiens
CASSLGYGSTDTQYF

SEQ ID NO: 1001 - protein, 13 aa, Homo sapiens
CASSLRANNEQFF

SEQ ID NO: 1002 - protein, 15 aa, Homo sapiens
CASSLVGASENIQYF

SEQ ID NO: 1003 - protein, 17 aa, Homo sapiens
CASSLVGLGSSYNEQFF

SEQ ID NO: 1004 - protein, 12 aa, Homo sapiens
CASSLWDDEQYF

SEQ ID NO: 1005 - protein, 14 aa, Homo sapiens
CASSPDREPMKQYF

SEQ ID NO: 1006 - protein, 13 aa, Homo sapiens
CASSPDRGNIQYF

SEQ ID NO: 1007 - protein, 12 aa, Homo sapiens
CASSPGPYEQYF

SEQ ID NO: 1008 - protein, 15 aa, Homo sapiens
CASSSGQGARETQYF

SEQ ID NO: 1009 - protein, 16 aa, Homo sapiens
CASSSRRGLEDNEQFF

SEQ ID NO: 1010 - protein, 16 aa, Homo sapiens
CASSSRWDASGNTIYF

SEQ ID NO: 1011 - protein, 17 aa, Homo sapiens
CASSSTDRGPRDQPQHF

SEQ ID NO: 1012 - protein, 19 aa, Homo sapiens
CASTPTGTRLVEVTYEQYF

SEQ ID NO: 1013 - protein, 15 aa, Homo sapiens
CASTPWADSYNEQFF

SEQ ID NO: 1014 - protein, 17 aa, Homo sapiens
CASGNPKGQGDTGELFF

SEQ ID NO: 1015 - protein, 12 aa, Homo sapiens
CASGQGAYEQYF

SEQ ID NO: 1016 - protein, 15 aa, Homo sapiens
CASSADSGVTYEQYF

SEQ ID NO: 1017 - protein, 13 aa, Homo sapiens
CASSAGDPDTQYF

SEQ ID NO: 1018 - protein, 14 aa, Homo sapiens
CASSAPYGGETQYF

SEQ ID NO: 1019 - protein, 15 aa, Homo sapiens
CASSASSGTTYEQYF

SEQ ID NO: 1020 - protein, 14 aa, Homo sapiens
CASSDPNRADTQYF

SEQ ID NO: 1021 - protein, 14 aa, Homo sapiens
CASSEEGAGYEQYF

SEQ ID NO: 1022 - protein, 16 aa, Homo sapiens
CASSESGGADYNEQFF

SEQ ID NO: 1023 - protein, 14 aa, Homo sapiens
CASSGEGLNYEQYF

SEQ ID NO: 1024 - protein, 13 aa, Homo sapiens
CASSGHFQETQYF

SEQ ID NO: 1025 - protein, 17 aa, Homo sapiens
CASSGLAGGSGYNEQFF

SEQ ID NO: 1026 - protein, 17 aa, Homo sapiens
CASSHAGGSRGTGELFF

SEQ ID NO: 1027 - protein, 15 aa, Homo sapiens
CASSHGQAAWYGYTF

SEQ ID NO: 1028 - protein, 16 aa, Homo sapiens
CASSIGHSAGSGELFF

SEQ ID NO: 1029 - protein, 13 aa, Homo sapiens
CASSLRGNTEAFF

SEQ ID NO: 1030 - protein, 16 aa, Homo sapiens
CASSLSGAPRSDTQYF

SEQ ID NO: 1031 - protein, 15 aa, Homo sapiens
CASSPDRGWDTEAFF

SEQ ID NO: 1032 - protein, 15 aa, Homo sapiens
CASSPLARGNTEAFF

SEQ ID NO: 1033 - protein, 15 aa, Homo sapiens
CASSPRTAMNTEAFF

SEQ ID NO: 1034 - protein, 15 aa, Homo sapiens
CASSPRTERTDTQYF

SEQ ID NO: 1035 - protein, 15 aa, Homo sapiens
CASSPTFSGRNEQFF

SEQ ID NO: 1036 - protein, 14 aa, Homo sapiens
CASSPWGTGSEQYF

SEQ ID NO: 1037 - protein, 15 aa, Homo sapiens
CASSQGAEYQETQYF

SEQ ID NO: 1038 - protein, 12 aa, Homo sapiens
CASSSYSYEQYF

SEQ ID NO: 1039 - protein, 13 aa, Homo sapiens
CASSVASPGELFF

SEQ ID NO: 1040 - protein, 17 aa, Homo sapiens
CASSVDGSQYHKNIQYF

SEQ ID NO: 1041 - protein, 14 aa, Homo sapiens
CASSVDPARDIQYF

SEQ ID NO: 1042 - protein, 15 aa, Homo sapiens
CASSVDYRGNQPQHF

SEQ ID NO: 1043 - protein, 13 aa, Homo sapiens
CASSVEAKTEAFF

SEQ ID NO: 1044 - protein, 14 aa, Homo sapiens
CASSVGGDTGELFF

SEQ ID NO: 1045 - protein, 18 aa, Homo sapiens
CASSVGGLAVSSGNTIYF

SEQ ID NO: 1046 - protein, 16 aa, Homo sapiens
CASSVGGRTIEDEQYF

SEQ ID NO: 1047 - protein, 14 aa, Homo sapiens
CASSVGGSTGELFF

SEQ ID NO: 1048 - protein, 14 aa, Homo sapiens
CASSVVPNTDTQYF

SEQ ID NO: 1049 - protein, 14 aa, Homo sapiens
CASSVVSGTGELFF

SEQ ID NO: 1050 - protein, 17 aa, Homo sapiens
CASSGGSGSTFPNEQFF

SEQ ID NO: 1051 - protein, 14 aa, Homo sapiens
CASSKDSSSYEQYF

SEQ ID NO: 1052 - protein, 11 aa, Homo sapiens
CASSQGYEQYF

SEQ ID NO: 1053 - protein, 14 aa, Homo sapiens
CASSSTPTKETQYF

SEQ ID NO: 1054 - protein, 12 aa, Homo sapiens
CASSDHGPGQYF

SEQ ID NO: 1055 - protein, 15 aa, Homo sapiens
CASSESMGGSQPQHF

SEQ ID NO: 1056 - protein, 13 aa, Homo sapiens
CASSGRWYNEQFF

SEQ ID NO: 1057 - protein, 12 aa, Homo sapiens
CAIMDRSYEQYF

SEQ ID NO: 1058 - protein, 17 aa, Homo sapiens
CAIRAGTGGAVGTEAFF

SEQ ID NO: 1059 - protein, 13 aa, Homo sapiens
CAIRDMTRNEQFF

SEQ ID NO: 1060 - protein, 14 aa, Homo sapiens
CAIREDRRSSPLHF

SEQ ID NO: 1061 - protein, 17 aa, Homo sapiens
CAIRSLAGETPYNEQFF

SEQ ID NO: 1062 - protein, 15 aa, Homo sapiens
CAISEPDRGVYEQYF

SEQ ID NO: 1063 - protein, 16 aa, Homo sapiens
CAISERGGTGAYEQYF

SEQ ID NO: 1064 - protein, 15 aa, Homo sapiens
CAISESGGGSETQYF

SEQ ID NO: 1065 - protein, 17 aa, Homo sapiens
CAISETPSGNPTYEQYF

SEQ ID NO: 1066 - protein, 14 aa, Homo sapiens
CATGTGDSNQPQHF

SEQ ID NO: 1067 - protein, 16 aa, Homo sapiens
CATNYGLETGGYEQYF

SEQ ID NO: 1068 - protein, 14 aa, Homo sapiens
CASSLVGTSYEQYF

SEQ ID NO: 1069 - protein, 17 aa, Homo sapiens
CASSSPGEIQVTYEQYF

SEQ ID NO: 1070 - protein, 15 aa, Homo sapiens
CASSATGGFTDTQYF

SEQ ID NO: 1071 - protein, 12 aa, Homo sapiens
CASSEYYYEQYF

SEQ ID NO: 1072 - protein, 14 aa, Homo sapiens
CASSFNRVRDTQYF

SEQ ID NO: 1073 - protein, 13 aa, Homo sapiens
CASSLDFADTQYF

SEQ ID NO: 1074 - protein, 18 aa, Homo sapiens
CASSLDQGGGGGSYEQYF

SEQ ID NO: 1075 - protein, 16 aa, Homo sapiens
CASSLDSGRAQDTQYF

SEQ ID NO: 1076 - protein, 15 aa, Homo sapiens
CASSLESVNQETQYF

SEQ ID NO: 1077 - protein, 16 aa, Homo sapiens
CASSLEYPGTGIEQYF

SEQ ID NO: 1078 - protein, 15 aa, Homo sapiens
CASSLGAGGIYEQYF

SEQ ID NO: 1079 - protein, 18 aa, Homo sapiens
CASSLLLAGGPSTDTQYF

SEQ ID NO: 1080 - protein, 15 aa, Homo sapiens
CASSLNSYSNQPQHF

SEQ ID NO: 1081 - protein, 14 aa, Homo sapiens
CASSLVLGYTEAFF

SEQ ID NO: 1082 - protein, 16 aa, Homo sapiens
CASSLVPTGEDYGYTF

SEQ ID NO: 1083 - protein, 14 aa, Homo sapiens
CASSPPTGNGELFF

SEQ ID NO: 1084 - protein, 16 aa, Homo sapiens
CASSPQPGLGAETQYF

SEQ ID NO: 1085 - protein, 14 aa, Homo sapiens
CASSRTGGYTEAFF

SEQ ID NO: 1086 - protein, 14 aa, Homo sapiens
CASSRWADTNEQFF

SEQ ID NO: 1087 - protein, 15 aa, Homo sapiens
CASSSNVGEGNEQFF

SEQ ID NO: 1088 - protein, 15 aa, Homo sapiens
CASSSPSGGTYEQYF

SEQ ID NO: 1089 - protein, 16 aa, Homo sapiens
CASSWGGDSSTDTQYF

SEQ ID NO: 1090 - protein, 15 aa, Homo sapiens
CASSYFDSVNTEAFF

SEQ ID NO: 1091 - protein, 17 aa, Homo sapiens
CASSLDGTFLRTDTQYF

SEQ ID NO: 1092 - protein, 13 aa, Homo sapiens
CASSLDSSYEQYF

SEQ ID NO: 1093 - protein, 13 aa, Homo sapiens
CASSLGQGYEQYF

SEQ ID NO: 1094 - protein, 18 aa, Homo sapiens
CASSWGWESGRAFDEQFF

SEQ ID NO: 1095 - protein, 18 aa, Homo sapiens
CASIEMIGQGPNTGELFF

SEQ ID NO: 1096 - protein, 14 aa, Homo sapiens
CASPTVGLLETQYF

SEQ ID NO: 1097 - protein, 14 aa, Homo sapiens
CASPTVRLLETQYF

SEQ ID NO: 1098 - protein, 13 aa, Homo sapiens
CASRPGTSKEQYF

SEQ ID NO: 1099 - protein, 14 aa, Homo sapiens
CASSFETGRYEQYF

SEQ ID NO: 1100 - protein, 14 aa, Homo sapiens
CASSFGGEGETQYF

SEQ ID NO: 1101 - protein, 12 aa, Homo sapiens
CASSFREYEQYF

SEQ ID NO: 1102 - protein, 15 aa, Homo sapiens
CASSFWGPDDSPLHF

SEQ ID NO: 1103 - protein, 14 aa, Homo sapiens
CASSLEGKMVEAFF

SEQ ID NO: 1104 - protein, 13 aa, Homo sapiens
CASSLGSTDTQYF

SEQ ID NO: 1105 - protein, 14 aa, Homo sapiens
CASSLQGNTGELFF

SEQ ID NO: 1106 - protein, 15 aa, Homo sapiens
CASSNGQVWNTEAFF

SEQ ID NO: 1107 - protein, 15 aa, Homo sapiens
CASSPGEGRTDTQYF

SEQ ID NO: 1108 - protein, 13 aa, Homo sapiens
CASSPPAGTEAFF

SEQ ID NO: 1109 - protein, 16 aa, Homo sapiens
CASSRNRDRENYGYTF

SEQ ID NO: 1110 - protein, 16 aa, Homo sapiens
CASSRQGAAPANVLTF

SEQ ID NO: 1111 - protein, 15 aa, Homo sapiens
CASSRSSSSTDTQYF

SEQ ID NO: 1112 - protein, 12 aa, Homo sapiens
CASSSANYGYTF

SEQ ID NO: 1113 - protein, 12 aa, Homo sapiens
CASSSANYGYTF

SEQ ID NO: 1114 - protein, 12 aa, Homo sapiens
CASTDSPEKLFF

SEQ ID NO: 1115 - protein, 16 aa, Homo sapiens
CASTSRTVSSYNEQFF

SEQ ID NO: 1116 - protein, 11 aa, Homo sapiens
CAVAHTDTQYF

SEQ ID NO: 1117 - protein, 15 aa, Homo sapiens
CASGDGSTGGETQYF

SEQ ID NO: 1118 - protein, 19 aa, Homo sapiens
CASGLSRTSGTMSYNEQFF

SEQ ID NO: 1119 - protein, 15 aa, Homo sapiens
CASGSGQGRDNEQFF

SEQ ID NO: 1120 - protein, 15 aa, Homo sapiens
CASSAGQPGSYEQYF

SEQ ID NO: 1121 - protein, 12 aa, Homo sapiens
CASSLDVGEQFF

SEQ ID NO: 1122 - protein, 16 aa, Homo sapiens
CASSLEGLSNTGELFF

SEQ ID NO: 1123 - protein, 15 aa, Homo sapiens
CASSLGRGLNQPQHF

SEQ ID NO: 1124 - protein, 15 aa, Homo sapiens
CASSQLQQGLTEAFF

SEQ ID NO: 1125 - protein, 16 aa, Homo sapiens
CASSSHGTQGSYEQYF

SEQ ID NO: 1126 - protein, 13 aa, Homo sapiens
CASSPDRGNEQFF

SEQ ID NO: 1127 - protein, 14 aa, Homo sapiens
CASSQDYVMDEQYF

SEQ ID NO: 1128 - protein, 17 aa, Homo sapiens
CASSQGQLAGLNYEQYF

SEQ ID NO: 1129 - protein, 14 aa, Homo sapiens
CATQVGGGSYEQYF

SEQ ID NO: 1130 - protein, 17 aa, Homo sapiens
CATSDEGQGARTGELFF

SEQ ID NO: 1131 - protein, 14 aa, Homo sapiens
CATSEGLALGEQFF

SEQ ID NO: 1132 - protein, 16 aa, Homo sapiens
CATSFSRDRGNQPQHF

SEQ ID NO: 1133 - protein, 14 aa, Homo sapiens
CATSRDMLTDTQYF

SEQ ID NO: 1134 - protein, 15 aa, Homo sapiens
CATSRDRGGTGELFF

SEQ ID NO: 1135 - protein, 15 aa, Homo sapiens
CATSRDSIGGTEQFF

SEQ ID NO: 1136 - protein, 15 aa, Homo sapiens
CATSRGLAGAYEQYF

SEQ ID NO: 1137 - protein, 13 aa, Homo sapiens
CATSSIPGEAIYF

SEQ ID NO: 1138 - protein, 13 aa, Homo sapiens
CATSTGQGYEQYF

SEQ ID NO: 1139 - protein, 16 aa, Homo sapiens
CASSPAGRTYSYEQYF

SEQ ID NO: 1140 - protein, 13 aa, Homo sapiens
CASSPEGGPTQYF

SEQ ID NO: 1141 - protein, 11 aa, Homo sapiens
CASSPGIEQYF

SEQ ID NO: 1142 - protein, 14 aa, Homo sapiens
CASSPGQGYYGYTF

SEQ ID NO: 1143 - protein, 15 aa, Homo sapiens
CASSPQDLLYYEQYF

SEQ ID NO: 1144 - protein, 16 aa, Homo sapiens
CASSPQWGTGEYEQFF

SEQ ID NO: 1145 - protein, 15 aa, Homo sapiens
CASSSYGTGGDEQFF

SEQ ID NO: 1146 - protein, 13 aa, Homo sapiens
CAAKMGVTGELFF

SEQ ID NO: 1147 - protein, 13 aa, Homo sapiens
CARDPEEANVLTF

SEQ ID NO: 1148 - protein, 12 aa, Homo sapiens
CASGPPNYGYTF

SEQ ID NO: 1149 - protein, 15 aa, Homo sapiens
CASMGFGSATDTQYF

SEQ ID NO: 1150 - protein, 11 aa, Homo sapiens
CASRGAGALHF

SEQ ID NO: 1151 - protein, 14 aa, Homo sapiens
CASRGQGARNEQFF

SEQ ID NO: 1152 - protein, 14 aa, Homo sapiens
CASRSSGRALEQYF

SEQ ID NO: 1153 - protein, 15 aa, Homo sapiens
CASSADRGLIQPQHF

SEQ ID NO: 1154 - protein, 15 aa, Homo sapiens
CASSARGHSGNTIYF

SEQ ID NO: 1155 - protein, 16 aa, Homo sapiens
CASSASGASSYNEQFF

SEQ ID NO: 1156 - protein, 16 aa, Homo sapiens
CASSIDADRGLGGYTF

SEQ ID NO: 1157 - protein, 15 aa, Homo sapiens
CASSIELLNREKLFF

SEQ ID NO: 1158 - protein, 16 aa, Homo sapiens
CASSIGGGRWNNEQFF

SEQ ID NO: 1159 - protein, 17 aa, Homo sapiens
CASSIGTGGFFANTQYF

SEQ ID NO: 1160 - protein, 15 aa, Homo sapiens
CASSIMGQGGQPQHF

SEQ ID NO: 1161 - protein, 13 aa, Homo sapiens
CASSIPWTGELFF

SEQ ID NO: 1162 - protein, 15 aa, Homo sapiens
CASSIQASSYNEQFF

SEQ ID NO: 1163 - protein, 15 aa, Homo sapiens
CASSIQLVPVETQYF

SEQ ID NO: 1164 - protein, 16 aa, Homo sapiens
CASSIRADPAYNEQFF

SEQ ID NO: 1165 - protein, 16 aa, Homo sapiens
CASSIRGYLSYNEQFF

SEQ ID NO: 1166 - protein, 13 aa, Homo sapiens
CASSITFSYEQYF

SEQ ID NO: 1167 - protein, 16 aa, Homo sapiens
CASSIVAGASNQPQHF

SEQ ID NO: 1168 - protein, 13 aa, Homo sapiens
CASSIVQTNEQFF

SEQ ID NO: 1169 - protein, 16 aa, Homo sapiens
CASSIVSSRYTDTQYF

SEQ ID NO: 1170 - protein, 14 aa, Homo sapiens
CASSKGYGNQPQHF

SEQ ID NO: 1171 - protein, 16 aa, Homo sapiens
CASSLGTGEMNTEAFF

SEQ ID NO: 1172 - protein, 14 aa, Homo sapiens
CASSLGTVNTEAFF

SEQ ID NO: 1173 - protein, 14 aa, Homo sapiens
CASSLSEIRYEQYF

SEQ ID NO: 1174 - protein, 13 aa, Homo sapiens
CASSMGGPDTQYF

SEQ ID NO: 1175 - protein, 15 aa, Homo sapiens
CASSMWVANTGELFF

SEQ ID NO: 1176 - protein, 15 aa, Homo sapiens
CASSPHRGGNYGYTF

SEQ ID NO: 1177 - protein, 17 aa, Homo sapiens
CASSPLRGDSPYNEQFF

SEQ ID NO: 1178 - protein, 15 aa, Homo sapiens
CASSRAPEGNTEAFF

SEQ ID NO: 1179 - protein, 18 aa, Homo sapiens
CASSSSDRAVIWTGELFF

SEQ ID NO: 1180 - protein, 15 aa, Homo sapiens
CASTAGAFTYNEQFF

SEQ ID NO: 1181 - protein, 19 aa, Homo sapiens
CASTAIGGTGQYSNQPQHF

SEQ ID NO: 1182 - protein, 13 aa, Homo sapiens
CASTGSIFNEQFF

SEQ ID NO: 1183 - protein, 16 aa, Homo sapiens
CASTNGLAGVEGELFF

SEQ ID NO: 1184 - protein, 16 aa, Homo sapiens
CASTPRPAGEGEKLFF

SEQ ID NO: 1185 - protein, 15 aa, Homo sapiens
CASTQGSSYNSPLHF

SEQ ID NO: 1186 - protein, 13 aa, Homo sapiens
CASTYSDTGELFF

SEQ ID NO: 1187 - protein, 13 aa, Homo sapiens
CATEGQGLGEQFF

SEQ ID NO: 1188 - protein, 12 aa, Homo sapiens
CSADHRGDEQFF

SEQ ID NO: 1189 - protein, 17 aa, Homo sapiens
CSADSLTGQGAGDTQYF

SEQ ID NO: 1190 - protein, 15 aa, Homo sapiens
CSAFRGAGDTDTQYF

SEQ ID NO: 1191 - protein, 15 aa, Homo sapiens
CSAFVGGRDYNEQFF

SEQ ID NO: 1192 - protein, 14 aa, Homo sapiens
CSAGPGDLNTEAFF

SEQ ID NO: 1193 - protein, 13 aa, Homo sapiens
CSAGQGESSPLHF

SEQ ID NO: 1194 - protein, 13 aa, Homo sapiens
CSAGTSDLNEQFF

SEQ ID NO: 1195 - protein, 12 aa, Homo sapiens
CSANDAPGGYTF

SEQ ID NO: 1196 - protein, 12 aa, Homo sapiens
CSANRERVEQYF

SEQ ID NO: 1197 - protein, 13 aa, Homo sapiens
CSAPGQPYNEQFF

SEQ ID NO: 1198 - protein, 17 aa, Homo sapiens
CSAPGTSGSGGIDTQYF

SEQ ID NO: 1199 - protein, 13 aa, Homo sapiens
CSAPSGQGYEQYF

SEQ ID NO: 1200 - protein, 14 aa, Homo sapiens
CSAPSSGRYNEQFF

SEQ ID NO: 1201 - protein, 14 aa, Homo sapiens
CSAPTETGAEKLFF

SEQ ID NO: 1202 - protein, 14 aa, Homo sapiens
CSAPTGVLVYGYTF

SEQ ID NO: 1203 - protein, 13 aa, Homo sapiens
CSAQGLYPNEQFF

SEQ ID NO: 1204 - protein, 16 aa, Homo sapiens
CSARASGSSNTGELFF

SEQ ID NO: 1205 - protein, 15 aa, Homo sapiens
CSARDFGSSSYEQYF

SEQ ID NO: 1206 - protein, 15 aa, Homo sapiens
CSARDGGRDTGELFF

SEQ ID NO: 1207 - protein, 16 aa, Homo sapiens
CSARDLSGSEDNEQFF

SEQ ID NO: 1208 - protein, 13 aa, Homo sapiens
CSARDRGSYEQYF

SEQ ID NO: 1209 - protein, 15 aa, Homo sapiens
CSARDSGSSWDEQFF

SEQ ID NO: 1210 - protein, 15 aa, Homo sapiens
CSARDVGAGTGELFF

SEQ ID NO: 1211 - protein, 14 aa, Homo sapiens
CSAREDREYQPQHF

SEQ ID NO: 1212 - protein, 11 aa, Homo sapiens
CSAREDYEQYF

SEQ ID NO: 1213 - protein, 14 aa, Homo sapiens
CSAREGHESSPLHF

SEQ ID NO: 1214 - protein, 14 aa, Homo sapiens
CSAREGLGHLEQYF

SEQ ID NO: 1215 - protein, 14 aa, Homo sapiens
CSAREGPSSYEQYF

SEQ ID NO: 1216 - protein, 15 aa, Homo sapiens
CSARELLGDSYEQYF

SEQ ID NO: 1217 - protein, 12 aa, Homo sapiens
CSARFQYNEQFF

SEQ ID NO: 1218 - protein, 14 aa, Homo sapiens
CSARGAGRGHEQFF

SEQ ID NO: 1219 - protein, 12 aa, Homo sapiens
CSARGDEETQYF

SEQ ID NO: 1220 - protein, 13 aa, Homo sapiens
CSARGFRAGEQFF

SEQ ID NO: 1221 - protein, 15 aa, Homo sapiens
CSARGFSGPNYEQYF

SEQ ID NO: 1222 - protein, 14 aa, Homo sapiens
CSARGPLRFYEQFF

SEQ ID NO: 1223 - protein, 16 aa, Homo sapiens
CSARPGQGGGYYEQYF

SEQ ID NO: 1224 - protein, 15 aa, Homo sapiens
CSARSGTSAPYEQYF

SEQ ID NO: 1225 - protein, 14 aa, Homo sapiens
CSARSPSTDYEQYF

SEQ ID NO: 1226 - protein, 13 aa, Homo sapiens
CSARSQGDYEQYF

SEQ ID NO: 1227 - protein, 13 aa, Homo sapiens
CSARSTGFYEQYF

SEQ ID NO: 1228 - protein, 14 aa, Homo sapiens
CSARSTGGETEAFF

SEQ ID NO: 1229 - protein, 12 aa, Homo sapiens
CSARTGGAEAFF

SEQ ID NO: 1230 - protein, 13 aa, Homo sapiens
CSARTGSTGELFF

SEQ ID NO: 1231 - protein, 15 aa, Homo sapiens
CSASNIAGGRETQYF

SEQ ID NO: 1232 - protein, 14 aa, Homo sapiens
CSASPGTDNSPLHF

SEQ ID NO: 1233 - protein, 17 aa, Homo sapiens
CSASRPRPGGGSYEQYF

SEQ ID NO: 1234 - protein, 13 aa, Homo sapiens
CSASSLAGNEQFF

SEQ ID NO: 1235 - protein, 12 aa, Homo sapiens
CSATSTVYEQYF

SEQ ID NO: 1236 - protein, 15 aa, Homo sapiens
CSAYQEDVSGNTIYF

SEQ ID NO: 1237 - protein, 13 aa, Homo sapiens
CSDATGESDTQYF

SEQ ID NO: 1238 - protein, 15 aa, Homo sapiens
CSGDTWEAGQETQYF

SEQ ID NO: 1239 - protein, 13 aa, Homo sapiens
CSGRKADSYEQYF

SEQ ID NO: 1240 - protein, 18 aa, Homo sapiens
CASSKAGDTFRGQETQYF

SEQ ID NO: 1241 - protein, 15 aa, Homo sapiens
CASSHLQGYGNTIYF

SEQ ID NO: 1242 - protein, 15 aa, Homo sapiens
CASSQGGGEVDEQFF

SEQ ID NO: 1243 - protein, 17 aa, Homo sapiens
CASSQSAPGLVDNEQFF

SEQ ID NO: 1244 - protein, 14 aa, Homo sapiens
CATSDANSNQPQHF

SEQ ID NO: 1245 - protein, 16 aa, Homo sapiens
CATSDPMTGGTNEQYF

SEQ ID NO: 1246 - protein, 16 aa, Homo sapiens
CATSDSPGQGSGELFF

SEQ ID NO: 1247 - protein, 16 aa, Homo sapiens
CATSDYRDSTYNEQFF

SEQ ID NO: 1248 - protein, 13 aa, Homo sapiens
CATSPAIYNEQFF

SEQ ID NO: 1249 - protein, 17 aa, Homo sapiens
CATSPGTSGRLSNEQFF

SEQ ID NO: 1250 - protein, 12 aa, Homo sapiens
CATVLGNTEAFF

SEQ ID NO: 1251 - protein, 14 aa, Homo sapiens
CATVRKINTGELFF

SEQ ID NO: 1252 - protein, 15 aa, Homo sapiens
CASREDSWSFGELFF

SEQ ID NO: 1253 - protein, 12 aa, Homo sapiens
CASRPGTDTQYF

SEQ ID NO: 1254 - protein, 16 aa, Homo sapiens
CASSEETGGTSTEAFF

SEQ ID NO: 1255 - protein, 15 aa, Homo sapiens
CASSPGQFDTGELFF

SEQ ID NO: 1256 - protein, 11 aa, Homo sapiens
CASTAGDTIYF

SEQ ID NO: 1257 - protein, 15 aa, Homo sapiens
CAILNSPGQYRTQYF

SEQ ID NO: 1258 - protein, 17 aa, Homo sapiens
CANTFDPPGQGNPEAFF

SEQ ID NO: 1259 - protein, 15 aa, Homo sapiens
CASAFFGEAGYGYTF

SEQ ID NO: 1260 - protein, 13 aa, Homo sapiens
CASGDRENEKLFF

SEQ ID NO: 1261 - protein, 15 aa, Homo sapiens
CASILSTGNNHPQLF

SEQ ID NO: 1262 - protein, 15 aa, Homo sapiens
CASLSREAPLDTQYF

SEQ ID NO: 1263 - protein, 12 aa, Homo sapiens
CASRGLYNEQFF

SEQ ID NO: 1264 - protein, 13 aa, Homo sapiens
CASRIGTYTEAFF

SEQ ID NO: 1265 - protein, 15 aa, Homo sapiens
CASRPSWREGGEQYF

SEQ ID NO: 1266 - protein, 12 aa, Homo sapiens
CASRRGYNEQFF

SEQ ID NO: 1267 - protein, 14 aa, Homo sapiens
CASRSGTGTDTQYF

SEQ ID NO: 1268 - protein, 15 aa, Homo sapiens
CASSADWDREAEAFF

SEQ ID NO: 1269 - protein, 14 aa, Homo sapiens
CASSAGGTNYGYTF

SEQ ID NO: 1270 - protein, 13 aa, Homo sapiens
CASSEFVQETQYF

SEQ ID NO: 1271 - protein, 15 aa, Homo sapiens
CASSFGGRALNEQFF

SEQ ID NO: 1272 - protein, 15 aa, Homo sapiens
CASSFGLAKYNEQFF

SEQ ID NO: 1273 - protein, 14 aa, Homo sapiens
CASSFSGTNEKLFF

SEQ ID NO: 1274 - protein, 16 aa, Homo sapiens
CASSFTLGTGGNEQYF

SEQ ID NO: 1275 - protein, 16 aa, Homo sapiens
CASSFTTSGATDTQYF

SEQ ID NO: 1276 - protein, 15 aa, Homo sapiens
CASSLAGDGYNEQFF

SEQ ID NO: 1277 - protein, 14 aa, Homo sapiens
CASSLAGSNTEAFF

SEQ ID NO: 1278 - protein, 12 aa, Homo sapiens
CASSLDKDTQYF

SEQ ID NO: 1279 - protein, 16 aa, Homo sapiens
CASSLFGQVGFTEAFF

SEQ ID NO: 1280 - protein, 15 aa, Homo sapiens
CASSLFQGGPTEAFF

SEQ ID NO: 1281 - protein, 14 aa, Homo sapiens
CASSLGGGWNEQFF

SEQ ID NO: 1282 - protein, 12 aa, Homo sapiens
CASSLHTGELFF

SEQ ID NO: 1283 - protein, 13 aa, Homo sapiens
CASSLIGQIEQFF

SEQ ID NO: 1284 - protein, 17 aa, Homo sapiens
CASSLLPRQAPGNEQFF

SEQ ID NO: 1285 - protein, 18 aa, Homo sapiens
CASSLSFGSSGIRREQFF

SEQ ID NO: 1286 - protein, 12 aa, Homo sapiens
CASSLVNSPLHF

SEQ ID NO: 1287 - protein, 16 aa, Homo sapiens
CASSLWASGSTDTQYF

SEQ ID NO: 1288 - protein, 13 aa, Homo sapiens
CASSLYSSYEQYF

SEQ ID NO: 1289 - protein, 15 aa, Homo sapiens
CASSPDRSSYNEQFF

SEQ ID NO: 1290 - protein, 16 aa, Homo sapiens
CASSPGLAGTYNEQFF

SEQ ID NO: 1291 - protein, 15 aa, Homo sapiens
CASSPGLIGTGELFF

SEQ ID NO: 1292 - protein, 13 aa, Homo sapiens
CASSPGPNNEQFF

SEQ ID NO: 1293 - protein, 13 aa, Homo sapiens
CASSPGRTYEQYF

SEQ ID NO: 1294 - protein, 16 aa, Homo sapiens
CASSPPGIAGVNEQFF

SEQ ID NO: 1295 - protein, 16 aa, Homo sapiens
CASSPQSYRVDQPQHF

SEQ ID NO: 1296 - protein, 17 aa, Homo sapiens
CASSRFWGGASTDTQYF

SEQ ID NO: 1297 - protein, 14 aa, Homo sapiens
CASSSLQGDDEQYF

SEQ ID NO: 1298 - protein, 16 aa, Homo sapiens
CASSSSLETGDTEAFF

SEQ ID NO: 1299 - protein, 11 aa, Homo sapiens
CASSTAYEQYF

SEQ ID NO: 1300 - protein, 12 aa, Homo sapiens
CASSTPPGEQYF

SEQ ID NO: 1301 - protein, 16 aa, Homo sapiens
CASSWGGGGSIYEQYF

SEQ ID NO: 1302 - protein, 13 aa, Homo sapiens
CASSWRGTGELFF

SEQ ID NO: 1303 - protein, 14 aa, Homo sapiens
CASSWTGYSYEQYF

SEQ ID NO: 1304 - protein, 14 aa, Homo sapiens
CASTAGLATGELFF

SEQ ID NO: 1305 - protein, 14 aa, Homo sapiens
CASYGRVSTGELFF

SEQ ID NO: 1306 - protein, 15 aa, Homo sapiens
CATWGGAAGSYEQYF

SEQ ID NO: 1307 - protein, 15 aa, Homo sapiens
WATIFSGTGKIDHFF

SEQ ID NO: 1308 - protein, 13 aa, Homo sapiens
CASKSSGGDTQYF

SEQ ID NO: 1309 - protein, 17 aa, Homo sapiens
CASKTVNRGFGTDTQYF

SEQ ID NO: 1310 - protein, 14 aa, Homo sapiens
CASNGEREGYEQYF

SEQ ID NO: 1311 - protein, 14 aa, Homo sapiens
CASRNSADSYEQYF

SEQ ID NO: 1312 - protein, 19 aa, Homo sapiens
CASRNTDPWGVRSTDTQYF

SEQ ID NO: 1313 - protein, 14 aa, Homo sapiens
CASRPGQAYNEQFF

SEQ ID NO: 1314 - protein, 12 aa, Homo sapiens
CASRRRMTEAFF

SEQ ID NO: 1315 - protein, 13 aa, Homo sapiens
CASRTDGSETQYF

SEQ ID NO: 1316 - protein, 13 aa, Homo sapiens
CASRTSGTDTQYF

SEQ ID NO: 1317 - protein, 15 aa, Homo sapiens
CASSAGTGGNTEAFF

SEQ ID NO: 1318 - protein, 13 aa, Homo sapiens
CASSFAEAYEQYF

SEQ ID NO: 1319 - protein, 16 aa, Homo sapiens
CASSFDRDRGPQPQHF

SEQ ID NO: 1320 - protein, 14 aa, Homo sapiens
CASSFGFSGNTIYF

SEQ ID NO: 1321 - protein, 14 aa, Homo sapiens
CASSFGGPNTEAFF

SEQ ID NO: 1322 - protein, 13 aa, Homo sapiens
CASSFLGYTEAFF

SEQ ID NO: 1323 - protein, 14 aa, Homo sapiens
CASSFLSGTDTQYF

SEQ ID NO: 1324 - protein, 13 aa, Homo sapiens
CASSFQGYTEAFF

SEQ ID NO: 1325 - protein, 14 aa, Homo sapiens
CASSFSTDGTEAFF

SEQ ID NO: 1326 - protein, 14 aa, Homo sapiens
CASSFSTSGNTIYF

SEQ ID NO: 1327 - protein, 15 aa, Homo sapiens
CASSFYSTNTGELFF

SEQ ID NO: 1328 - protein, 13 aa, Homo sapiens
CASSGLAGGEQFF

SEQ ID NO: 1329 - protein, 11 aa, Homo sapiens
CASSILTEAFF

SEQ ID NO: 1330 - protein, 11 aa, Homo sapiens
CASSLADTQYF

SEQ ID NO: 1331 - protein, 15 aa, Homo sapiens
CASSLEQGGNEKLFF

SEQ ID NO: 1332 - protein, 16 aa, Homo sapiens
CASSLEWTGGVYEQFF

SEQ ID NO: 1333 - protein, 16 aa, Homo sapiens
CASSLFWETAQETQYF

SEQ ID NO: 1334 - protein, 13 aa, Homo sapiens
CASSLLQGNIQYF

SEQ ID NO: 1335 - protein, 14 aa, Homo sapiens
CASSLLTGRTEAFF

SEQ ID NO: 1336 - protein, 14 aa, Homo sapiens
CASSLPTGEQPQHF

SEQ ID NO: 1337 - protein, 14 aa, Homo sapiens
CASSLRGSNQPQHF

SEQ ID NO: 1338 - protein, 18 aa, Homo sapiens
CASSLSGLAGWSDNEQFF

SEQ ID NO: 1339 - protein, 14 aa, Homo sapiens
CASSLSSGRYEQYF

SEQ ID NO: 1340 - protein, 15 aa, Homo sapiens
CASSLVPGRNTEAFF

SEQ ID NO: 1341 - protein, 12 aa, Homo sapiens
CASSLYGGELFF

SEQ ID NO: 1342 - protein, 15 aa, Homo sapiens
CASSPGANGADTIYF

SEQ ID NO: 1343 - protein, 11 aa, Homo sapiens
CASSPGPEAFF

SEQ ID NO: 1344 - protein, 16 aa, Homo sapiens
CASSPPWRPQTDTQYF

SEQ ID NO: 1345 - protein, 15 aa, Homo sapiens
CASSPSPAGAYGYTF

SEQ ID NO: 1346 - protein, 14 aa, Homo sapiens
CASSRQLLNEKLFF

SEQ ID NO: 1347 - protein, 14 aa, Homo sapiens
CASSRSGASYEQYF

SEQ ID NO: 1348 - protein, 11 aa, Homo sapiens
CASSSLGEQYF

SEQ ID NO: 1349 - protein, 12 aa, Homo sapiens
CASSSLTYEQYF

SEQ ID NO: 1350 - protein, 14 aa, Homo sapiens
CASSSQDSSYEQYF

SEQ ID NO: 1351 - protein, 12 aa, Homo sapiens
CASSSSGTEQYF

SEQ ID NO: 1352 - protein, 12 aa, Homo sapiens
CASSSTAIEQFF

SEQ ID NO: 1353 - protein, 15 aa, Homo sapiens
CASSTLVGGAAEAFF

SEQ ID NO: 1354 - protein, 11 aa, Homo sapiens
CASSTYNEQFF

SEQ ID NO: 1355 - protein, 16 aa, Homo sapiens
CASSVSGTSGRNEQFF

SEQ ID NO: 1356 - protein, 15 aa, Homo sapiens
CASSYLDAGNSPLHF

SEQ ID NO: 1357 - protein, 15 aa, Homo sapiens
CASSYLSDGTYEQYF

SEQ ID NO: 1358 - protein, 12 aa, Homo sapiens
CASTAPRGPQHF

SEQ ID NO: 1359 - protein, 16 aa, Homo sapiens
CASTITAGQVNYEQYF

SEQ ID NO: 1360 - protein, 14 aa, Homo sapiens
CASTLRVGVGELFF

SEQ ID NO: 1361 - protein, 17 aa, Homo sapiens
CATKQGARTSDTGELFF

SEQ ID NO: 1362 - protein, 14 aa, Homo sapiens
CAVQGGSGTGELFF

SEQ ID NO: 1363 - protein, 13 aa, Homo sapiens
CSAGTSSTGELFF

SEQ ID NO: 1364 - protein, 10 aa, Homo sapiens
CSAHEETQYF

SEQ ID NO: 1365 - protein, 15 aa, Homo sapiens
CSASFETELNQPQHF

SEQ ID NO: 1366 - protein, 13 aa, Homo sapiens
CSSIGELLDGYTF

SEQ ID NO: 1367 - protein, 14 aa, Homo sapiens
CSVDWVREQETQYF

SEQ ID NO: 1368 - protein, 15 aa, Homo sapiens
CSVEASGWGKDTQYF

SEQ ID NO: 1369 - protein, 15 aa, Homo sapiens
CSVEDELAGGHEQFF

SEQ ID NO: 1370 - protein, 13 aa, Homo sapiens
CSVEEFTDTEAFF

SEQ ID NO: 1371 - protein, 12 aa, Homo sapiens
CSVEQDTYGYTF

SEQ ID NO: 1372 - protein, 14 aa, Homo sapiens
CSVERAWKQTEAFF

SEQ ID NO: 1373 - protein, 11 aa, Homo sapiens
CSVESANGYTF

SEQ ID NO: 1374 - protein, 11 aa, Homo sapiens
CSVESYNEQFF

SEQ ID NO: 1375 - protein, 16 aa, Homo sapiens
CSVEVPLVLDYNEQFF

SEQ ID NO: 1376 - protein, 12 aa, Homo sapiens
CSVEVRLNEQFF

SEQ ID NO: 1377 - protein, 13 aa, Homo sapiens
CSVGAPGSDTQYF

SEQ ID NO: 1378 - protein, 17 aa, Homo sapiens
CSVNTGTGHPSGHGYTF

SEQ ID NO: 1379 - protein, 13 aa, Homo sapiens
CSVPSRMNTEAFF

SEQ ID NO: 1380 - protein, 15 aa, Homo sapiens
CAWSVGFLAGYEQYF

SEQ ID NO: 1381 - protein, 12 aa, Homo sapiens
CAWSVLSDEQFF

SEQ ID NO: 1382 - protein, 15 aa, Homo sapiens
CAWSPPGTLTYEQYF

SEQ ID NO: 1383 - protein, 16 aa, Homo sapiens
CAWQTRARGRNSPLHF

SEQ ID NO: 1384 - protein, 16 aa, Homo sapiens
CAWRPPGQGPGNTIYF

SEQ ID NO: 1385 - protein, 12 aa, Homo sapiens
CAWSVGNTEAFF

SEQ ID NO: 1386 - protein, 13 aa, Homo sapiens
CAWSTGNEETQYF

SEQ ID NO: 1387 - protein, 14 aa, Homo sapiens
CAWTPGRGREKLFF

SEQ ID NO: 1388 - protein, 11 aa, Homo sapiens
CAWSAATEAFF

SEQ ID NO: 1389 - protein, 14 aa, Homo sapiens
CAWSRGAGSNEAFF

SEQ ID NO: 1390 - protein, 13 aa, Homo sapiens
CAWSVFGGTEAFF

SEQ ID NO: 1391 - protein, 14 aa, Homo sapiens
CAWSVGEAAYEQYF

SEQ ID NO: 1392 - protein, 12 aa, Homo sapiens
CAWKGEGAEQFF

SEQ ID NO: 1393 - protein, 12 aa, Homo sapiens
CASGKLGQPQHF

SEQ ID NO: 1394 - protein, 16 aa, Homo sapiens
CASKGLAGVKAGEQYF

SEQ ID NO: 1395 - protein, 13 aa, Homo sapiens
CASRDFSEDEQFF

SEQ ID NO: 1396 - protein, 15 aa, Homo sapiens
CASRGLLGSNQPQHF

SEQ ID NO: 1397 - protein, 15 aa, Homo sapiens
CASSEMVTSRETQYF

SEQ ID NO: 1398 - protein, 12 aa, Homo sapiens
CASSGGGGELFF

SEQ ID NO: 1399 - protein, 17 aa, Homo sapiens
CASSIKGSASGFNEQFF

SEQ ID NO: 1400 - protein, 17 aa, Homo sapiens
CASSKIVGGPISSPLHF

SEQ ID NO: 1401 - protein, 14 aa, Homo sapiens
CASSQDPGDYEQYF

SEQ ID NO: 1402 - protein, 14 aa, Homo sapiens
CASSQDPGDYEQYF

SEQ ID NO: 1403 - protein, 15 aa, Homo sapiens
CASSSTSGPTYEQYF

SEQ ID NO: 1404 - protein, 15 aa, Homo sapiens
CASSYFEQGSRELFF

SEQ ID NO: 1405 - protein, 13 aa, Homo sapiens
CASSYGGVEGQYF

SEQ ID NO: 1406 - protein, 13 aa, Homo sapiens
CASSYGGVEGQYF

SEQ ID NO: 1407 - protein, 13 aa, Homo sapiens
CASSYGGVEGQYF

SEQ ID NO: 1408 - protein, 13 aa, Homo sapiens
CASSYGGVEGQYF

SEQ ID NO: 1409 - protein, 13 aa, Homo sapiens
CASSYGGVEGQYF

SEQ ID NO: 1410 - protein, 13 aa, Homo sapiens
CASSYGGVEGQYF

SEQ ID NO: 1411 - protein, 13 aa, Homo sapiens
CASSYGGVEGQYF

SEQ ID NO: 1412 - protein, 13 aa, Homo sapiens
CASSYGGVEGQYF

SEQ ID NO: 1413 - protein, 13 aa, Homo sapiens
CASSYGGVEGQYF

SEQ ID NO: 1414 - protein, 13 aa, Homo sapiens
CASSYGGVEGQYF

SEQ ID NO: 1415 - protein, 13 aa, Homo sapiens
CASSYGGVEGQYF

SEQ ID NO: 1416 - protein, 13 aa, Homo sapiens
CASSYGGVEGQYF

SEQ ID NO: 1417 - protein, 13 aa, Homo sapiens
CASSYGGVEGQYF

SEQ ID NO: 1418 - protein, 13 aa, Homo sapiens
CASSYGGVEGQYF

SEQ ID NO: 1419 - protein, 13 aa, Homo sapiens
CASSYGGVEGQYF

SEQ ID NO: 1420 - protein, 13 aa, Homo sapiens
CASSYGGVEGQYF

SEQ ID NO: 1421 - protein, 13 aa, Homo sapiens
CASSYGGVEGQYF

SEQ ID NO: 1422 - protein, 13 aa, Homo sapiens
CASSYGGVEGQYF

SEQ ID NO: 1423 - protein, 14 aa, Homo sapiens
CASSYYDETYEQYF

SEQ ID NO: 1424 - protein, 14 aa, Homo sapiens
CASSYYDETYEQYF

SEQ ID NO: 1425 - protein, 11 aa, Homo sapiens
CASTRGDTQYF

SEQ ID NO: 1426 - protein, 15 aa, Homo sapiens
CATSNLRQPEQPQHF

SEQ ID NO: 1427 - protein, 13 aa, Homo sapiens
GATSYGGVEGKNF

SEQ ID NO: 1428 - protein, 16 aa, Homo sapiens
CAISTTERSSYNEQFF

SEQ ID NO: 1429 - protein, 17 aa, Homo sapiens
CASKPGGRDRGVGSLHF

SEQ ID NO: 1430 - protein, 15 aa, Homo sapiens
CASSDRGAGNQPQHF

SEQ ID NO: 1431 - protein, 14 aa, Homo sapiens
CASSDRGGVNEQYF

SEQ ID NO: 1432 - protein, 14 aa, Homo sapiens
CASSEIETYNEQFF

SEQ ID NO: 1433 - protein, 14 aa, Homo sapiens
CASSFQGRAYGYTF

SEQ ID NO: 1434 - protein, 15 aa, Homo sapiens
CASSGREDGYNEQFF

SEQ ID NO: 1435 - protein, 14 aa, Homo sapiens
CASSGTSVYNEQFF

SEQ ID NO: 1436 - protein, 15 aa, Homo sapiens
CASSGYSGRVYNEQF

SEQ ID NO: 1437 - protein, 14 aa, Homo sapiens
CASSIGPGWEPQHF

SEQ ID NO: 1438 - protein, 15 aa, Homo sapiens
CASSIGQGATDTQYF

SEQ ID NO: 1439 - protein, 14 aa, Homo sapiens
CASSISAYLYEQYF

SEQ ID NO: 1440 - protein, 15 aa, Homo sapiens
CASSITGTGGPGYTF

SEQ ID NO: 1441 - protein, 15 aa, Homo sapiens
CASSLAAGNSYEQYF

SEQ ID NO: 1442 - protein, 14 aa, Homo sapiens
CASSLAFGTDTQYF

SEQ ID NO: 1443 - protein, 16 aa, Homo sapiens
CASSLDFTEPGSEQYF

SEQ ID NO: 1444 - protein, 14 aa, Homo sapiens
CASSLGLGTGELFF

SEQ ID NO: 1445 - protein, 14 aa, Homo sapiens
CASSLGTPNTEAFF

SEQ ID NO: 1446 - protein, 14 aa, Homo sapiens
CASSLGYGEETQYF

SEQ ID NO: 1447 - protein, 14 aa, Homo sapiens
CASSLQGGGETQYF

SEQ ID NO: 1448 - protein, 13 aa, Homo sapiens
CASSLSGTGELFF

SEQ ID NO: 1449 - protein, 13 aa, Homo sapiens
CASSLSGTGELFF

SEQ ID NO: 1450 - protein, 13 aa, Homo sapiens
CASSLSGTGELFF

SEQ ID NO: 1451 - protein, 13 aa, Homo sapiens
CASSLSGTGELFF

SEQ ID NO: 1452 - protein, 13 aa, Homo sapiens
CASSLSGTGELFF

SEQ ID NO: 1453 - protein, 13 aa, Homo sapiens
CASSLSGTGELFF

SEQ ID NO: 1454 - protein, 13 aa, Homo sapiens
CASSLSGTGELFF

SEQ ID NO: 1455 - protein, 13 aa, Homo sapiens
CASSLSGTGELFF

SEQ ID NO: 1456 - protein, 13 aa, Homo sapiens
CASSLSGTGELFF

SEQ ID NO: 1457 - protein, 13 aa, Homo sapiens
CASSLSGTGELFF

SEQ ID NO: 1458 - protein, 13 aa, Homo sapiens
CASSLSGTGELFF

SEQ ID NO: 1459 - protein, 13 aa, Homo sapiens
CASSLSGTGELFF

SEQ ID NO: 1460 - protein, 13 aa, Homo sapiens
CASSLSGTGELFF

SEQ ID NO: 1461 - protein, 13 aa, Homo sapiens
CASSLSGTGELFF

SEQ ID NO: 1462 - protein, 13 aa, Homo sapiens
CASSLSGTGELFF

SEQ ID NO: 1463 - protein, 13 aa, Homo sapiens
CASSLSGTGELFF

SEQ ID NO: 1464 - protein, 13 aa, Homo sapiens
CASSLSGTGELFF

SEQ ID NO: 1465 - protein, 13 aa, Homo sapiens
CASSLSGTGELFF

SEQ ID NO: 1466 - protein, 13 aa, Homo sapiens
CASSLSGTGELFF

SEQ ID NO: 1467 - protein, 13 aa, Homo sapiens
CASSLSGTGELFF

SEQ ID NO: 1468 - protein, 13 aa, Homo sapiens
CASSLSGTGELFF

SEQ ID NO: 1469 - protein, 13 aa, Homo sapiens
CASSLSGTGELFF

SEQ ID NO: 1470 - protein, 13 aa, Homo sapiens
CASSLSGTGELFF

SEQ ID NO: 1471 - protein, 13 aa, Homo sapiens
CASSLSGTGELFF

SEQ ID NO: 1472 - protein, 13 aa, Homo sapiens
CASSLSGTGELFF

SEQ ID NO: 1473 - protein, 13 aa, Homo sapiens
CASSLSGTGELFF

SEQ ID NO: 1474 - protein, 13 aa, Homo sapiens
CASSLSGTGELFF

SEQ ID NO: 1475 - protein, 13 aa, Homo sapiens
CASSLSGTGELFF

SEQ ID NO: 1476 - protein, 13 aa, Homo sapiens
CASSLSGTGELFF

SEQ ID NO: 1477 - protein, 13 aa, Homo sapiens
CASSLSGTGELFF

SEQ ID NO: 1478 - protein, 13 aa, Homo sapiens
CASSLSGTGELFF

SEQ ID NO: 1479 - protein, 13 aa, Homo sapiens
CASSLSGTGELFF

SEQ ID NO: 1480 - protein, 13 aa, Homo sapiens
CASSLSGTGELFF

SEQ ID NO: 1481 - protein, 13 aa, Homo sapiens
CASSLSGTGELFF

SEQ ID NO: 1482 - protein, 13 aa, Homo sapiens
CASSLSGTGELFF

SEQ ID NO: 1483 - protein, 13 aa, Homo sapiens
CASSLSGTGELFF

SEQ ID NO: 1484 - protein, 13 aa, Homo sapiens
CASSLSGTGELFF

SEQ ID NO: 1485 - protein, 13 aa, Homo sapiens
CASSLSGTGELFF

SEQ ID NO: 1486 - protein, 13 aa, Homo sapiens
CASSLSGTGELFF

SEQ ID NO: 1487 - protein, 16 aa, Homo sapiens
CASSLSQGGNTDTQYF

SEQ ID NO: 1488 - protein, 16 aa, Homo sapiens
CASSLTGRGLDYGYTF

SEQ ID NO: 1489 - protein, 13 aa, Homo sapiens
CASSLYGTTEAFF

SEQ ID NO: 1490 - protein, 13 aa, Homo sapiens
CASSPGHADGYTF

SEQ ID NO: 1491 - protein, 18 aa, Homo sapiens
CASSPRGDNLDGSYGYTF

SEQ ID NO: 1492 - protein, 15 aa, Homo sapiens
CASSPTSSSYNEQFF

SEQ ID NO: 1493 - protein, 15 aa, Homo sapiens
CASSRGSLAGETQYF

SEQ ID NO: 1494 - protein, 12 aa, Homo sapiens
CASSSEDQPQHF

SEQ ID NO: 1495 - protein, 11 aa, Homo sapiens
CASSSGQEQFF

SEQ ID NO: 1496 - protein, 14 aa, Homo sapiens
CASSVGGSTYEQYF

SEQ ID NO: 1497 - protein, 15 aa, Homo sapiens
CASTNGGQGQETQYF

SEQ ID NO: 1498 - protein, 15 aa, Homo sapiens
CASTQAGQGANEQFF

SEQ ID NO: 1499 - protein, 15 aa, Homo sapiens
CATSEGRGGNQPQHF

SEQ ID NO: 1500 - protein, 15 aa, Homo sapiens
CATSEGRGGNQPQHF

SEQ ID NO: 1501 - protein, 15 aa, Homo sapiens
CATSEGRGGNQPQHF

SEQ ID NO: 1502 - protein, 15 aa, Homo sapiens
CATSEGRGGNQPQHF

SEQ ID NO: 1503 - protein, 15 aa, Homo sapiens
CATSEGRGGNQPQHF

SEQ ID NO: 1504 - protein, 15 aa, Homo sapiens
CATSEGRGGNQPQHF

SEQ ID NO: 1505 - protein, 15 aa, Homo sapiens
CATSEGRGGNQPQHF

SEQ ID NO: 1506 - protein, 15 aa, Homo sapiens
CATSEGRGGNQPQHF

SEQ ID NO: 1507 - protein, 16 aa, Homo sapiens
CATSRDPGQGADTQYF

SEQ ID NO: 1508 - protein, 15 aa, Homo sapiens
CAWSRTGGVNEKLFF

SEQ ID NO: 1509 - protein, 13 aa, Homo sapiens
CSATRMGTGGQYF

SEQ ID NO: 1510 - protein, 13 aa, Homo sapiens
CSLKGSGETEAFF

SEQ ID NO: 1511 - protein, 13 aa, Homo sapiens
CSVAHHLSYEQYF

SEQ ID NO: 1512 - protein, 13 aa, Homo sapiens
CSVVRGNTYEQYF

SEQ ID NO: 1513 - DNA, 18 bp, Artificial Sequence
  Description of Artificial Sequence: Synthetic primer
caccagtgtggccttttg

SEQ ID NO: 1514 - DNA, 21 bp, Artificial Sequence
  Description of Artificial Sequence: Synthetic primer
ggaacacgtttttcaggtcct

SEQ ID NO: 1515 - DNA, 24 bp, Artificial Sequence
  Description of Artificial Sequence: Synthetic primer
acagcaagtgactctgagatgctc

SEQ ID NO: 1516 - DNA, 24 bp, Artificial Sequence
  Description of Artificial Sequence: Synthetic primer
acagcaagtgacactgagatgctc

SEQ ID NO: 1517 - DNA, 24 bp, Artificial Sequence
  Description of Artificial Sequence: Synthetic primer
acagcaagtgacgctgagatgctc

SEQ ID NO: 1518 - DNA, 25 bp, Artificial Sequence
  Description of Artificial Sequence: Synthetic primer
gatcactctggaatgttctcaaacc

SEQ ID NO: 1519 - DNA, 24 bp, Artificial Sequence
  Description of Artificial Sequence: Synthetic primer
ccaagacacaaggtcacagagaca

SEQ ID NO: 1520 - DNA, 24 bp, Artificial Sequence
  Description of Artificial Sequence: Synthetic primer
gagtgccgttccctggactttcag

SEQ ID NO: 1521 - DNA, 24 bp, Artificial Sequence
  Description of Artificial Sequence: Synthetic primer
gtaacccagagctcgagatatcta

SEQ ID NO: 1522 - DNA, 24 bp, Artificial Sequence
  Description of Artificial Sequence: Synthetic primer
ggtcacacagatgggacaggaagt

SEQ ID NO: 1523 - DNA, 26 bp, Artificial Sequence
  Description of Artificial Sequence: Synthetic primer
tccagtgtcaagtcgatagccaagtc

SEQ ID NO: 1524 - DNA, 24 bp, Artificial Sequence
  Description of Artificial Sequence: Synthetic primer
atgtaactctcaggtgtgatccaa

SEQ ID NO: 1525 - DNA, 24 bp, Artificial Sequence
  Description of Artificial Sequence: Synthetic primer
atgtaactttcaggtgtgatccaa

SEQ ID NO: 1526 - DNA, 24 bp, Artificial Sequence
  Description of Artificial Sequence: Synthetic primer
gtgacccagaacccaagatacctc

SEQ ID NO: 1527 - DNA, 24 bp, Artificial Sequence
  Description of Artificial Sequence: Synthetic primer
gtgtgatccaatttcaggtcatac

SEQ ID NO: 1528 - DNA, 24 bp, Artificial Sequence
  Description of Artificial Sequence: Synthetic primer
ggtgacagagatgggacaagaagt

SEQ ID NO: 1529 - DNA, 27 bp, Artificial Sequence
  Description of Artificial Sequence: Synthetic primer
cagtctcccagatataagattatagag

SEQ ID NO: 1530 - DNA, 24 bp, Artificial Sequence
  Description of Artificial Sequence: Synthetic primer
cactcagtccccaaagtacctgtt

SEQ ID NO: 1531 - DNA, 27 bp, Artificial Sequence
  Description of Artificial Sequence: Synthetic primer
gtcagatctcagactattcatcaatgg

SEQ ID NO: 1532 - DNA, 26 bp, Artificial Sequence
  Description of Artificial Sequence: Synthetic primer
tacgcagacaccaagacacctggtca

SEQ ID NO: 1533 - DNA, 26 bp, Artificial Sequence
  Description of Artificial Sequence: Synthetic primer
tacgcagacaccaaaacacctggtca

SEQ ID NO: 1534 - DNA, 24 bp, Artificial Sequence
  Description of Artificial Sequence: Synthetic primer
cccagactccaaaatacctggtca

SEQ ID NO: 1535 - DNA, 24 bp, Artificial Sequence
  Description of Artificial Sequence: Synthetic primer
tgcagaacccaagacacctggtca

SEQ ID NO: 1536 - DNA, 24 bp, Artificial Sequence
  Description of Artificial Sequence: Synthetic primer
aaggtcacccagagacctagactt

SEQ ID NO: 1537 - DNA, 24 bp, Artificial Sequence
  Description of Artificial Sequence: Synthetic primer
atagaagctggagttactcagttc

SEQ ID NO: 1538 - DNA, 24 bp, Artificial Sequence
  Description of Artificial Sequence: Synthetic primer
acaaagatggattgtacccccgaa

SEQ ID NO: 1539 - DNA, 24 bp, Artificial Sequence
  Description of Artificial Sequence: Synthetic primer
gtgtcactcagaccccaaaattcc

SEQ ID NO: 1540 - DNA, 24 bp, Artificial Sequence
  Description of Artificial Sequence: Synthetic primer
gttacccagaccccaaggaatagg

SEQ ID NO: 1541 - DNA, 27 bp, Artificial Sequence
  Description of Artificial Sequence: Synthetic primer
ctgatcaaagaaaagagggaaacagcc

SEQ ID NO: 1542 - DNA, 24 bp, Artificial Sequence
  Description of Artificial Sequence: Synthetic primer
caagataccaggttacccagtttg

SEQ ID NO: 1543 - protein, 9 aa, Homo sapiens
RMFPNAPYL

SEQ ID NO: 1544 - protein, 9 aa, Homo sapiens
SLGEQQYSV

SEQ ID NO: 1545 - DNA, 42 bp, Homo sapiens; identical to SEQ ID NO: 304

SEQ ID NO: 1546 - DNA, 57 bp, Homo sapiens; identical to SEQ ID NO: 57

SEQ ID NO: 1547 - DNA, 39 bp, Homo sapiens; identical to SEQ ID NO: 504

SEQ ID NO: 1548 - DNA, 36 bp, Homo sapiens; identical to SEQ ID NO: 259

SEQ ID NO: 1549 - DNA, 45 bp, Homo sapiens; identical to SEQ ID NO: 393

SEQ ID NO: 1550 - DNA, 36 bp, Homo sapiens; identical to SEQ ID NO: 6

SEQ ID NO: 1551 - DNA, 39 bp, Homo sapiens; identical to SEQ ID NO: 559

SEQ ID NO: 1552 - DNA, 45 bp, Homo sapiens; identical to SEQ ID NO: 364

SEQ ID NO: 1553 - DNA, 45 bp, Homo sapiens; identical to SEQ ID NO: 14

SEQ ID NO: 1554 - DNA, 45 bp, Homo sapiens; identical to SEQ ID NO: 125

SEQ ID NO: 1555 - DNA, 45 bp, Homo sapiens; identical to SEQ ID NO: 83

SEQ ID NO: 1556 - DNA, 48 bp, Homo sapiens; identical to SEQ ID NO: 518

SEQ ID NO: 1557 - DNA, 51 bp, Homo sapiens; identical to SEQ ID NO: 403

SEQ ID NO: 1558 - DNA, 51 bp, Homo sapiens; identical to SEQ ID NO: 35

SEQ ID NO: 1559 - DNA, 48 bp, Homo sapiens; identical to SEQ ID NO: 228

SEQ ID NO: 1560 - DNA, 57 bp, Homo sapiens; identical to SEQ ID NO: 87

SEQ ID NO: 1561 - DNA, 42 bp, Homo sapiens; identical to SEQ ID NO: 238

SEQ ID NO: 1562 - DNA, 42 bp, Homo sapiens; identical to SEQ ID NO: 416

SEQ ID NO: 1563 - DNA, 39 bp, Homo sapiens; identical to SEQ ID NO: 245

SEQ ID NO: 1564 - DNA, 42 bp, Homo sapiens; identical to SEQ ID NO: 417

SEQ ID NO: 1565 - DNA, 48 bp, Homo sapiens; identical to SEQ ID NO: 274

SEQ ID NO: 1566 - DNA, 48 bp, Homo sapiens; identical to SEQ ID NO: 198

SEQ ID NO: 1567 - DNA, 48 bp, Homo sapiens; identical to SEQ ID NO: 135

SEQ ID NO: 1568 - DNA, 39 bp, Homo sapiens; identical to SEQ ID NO: 25

SEQ ID NO: 1569 - DNA, 42 bp, Homo sapiens; identical to SEQ ID NO: 39

SEQ ID NO: 1570 - DNA, 42 bp, Homo sapiens
tgtgccagcagcccccagggagactggaatgagcagttcttc

SEQ ID NO: 1571 - DNA, 48 bp, Homo sapiens; identical to SEQ ID NO: 53

SEQ ID NO: 1572 - DNA, 45 bp, Homo sapiens; identical to SEQ ID NO: 40

SEQ ID NO: 1573 - DNA, 45 bp, Homo sapiens; identical to SEQ ID NO: 40

SEQ ID NO: 1574 - DNA, 45 bp, Homo sapiens; identical to SEQ ID NO: 40

SEQ ID NO: 1575 - DNA, 51 bp, Homo sapiens; identical to SEQ ID NO: 105

SEQ ID NO: 1576 - DNA, 42 bp, Homo sapiens; identical to SEQ ID NO: 75

SEQ ID NO: 1577 - DNA, 42 bp, Homo sapiens; identical to SEQ ID NO: 280

SEQ ID NO: 1578 - DNA, 45 bp, Homo sapiens; identical to SEQ ID NO: 64

SEQ ID NO: 1579 - DNA, 45 bp, Homo sapiens; identical to SEQ ID NO: 486

SEQ ID NO: 1580 - DNA, 51 bp, Homo sapiens; identical to SEQ ID NO: 487

SEQ ID NO: 1581 - DNA, 45 bp, Homo sapiens; identical to SEQ ID NO: 74

SEQ ID NO: 1582 - DNA, 42 bp, Homo sapiens; identical to SEQ ID NO: 68

SEQ ID NO: 1583 - DNA, 48 bp, Homo sapiens; identical to SEQ ID NO: 542

SEQ ID NO: 1584 - DNA, 42 bp, Homo sapiens; identical to SEQ ID NO: 297

SEQ ID NO: 1585 - DNA, 36 bp, Homo sapiens; identical to SEQ ID NO: 282

SEQ ID NO: 1586 - DNA, 45 bp, Homo sapiens; identical to SEQ ID NO: 286

SEQ ID NO: 1587 - DNA, 45 bp, Homo sapiens; identical to SEQ ID NO: 601

SEQ ID NO: 1588 - DNA, 42 bp, Homo sapiens; identical to SEQ ID NO: 166

SEQ ID NO: 1589 - DNA, 42 bp, Homo sapiens; identical to SEQ ID NO: 166

SEQ ID NO: 1590 - DNA, 45 bp, Homo sapiens; identical to SEQ ID NO: 132

SEQ ID NO: 1591 - DNA, 42 bp, Homo sapiens; identical to SEQ ID NO: 119

SEQ ID NO: 1592 - DNA, 51 bp, Homo sapiens; identical to SEQ ID NO: 374

SEQ ID NO: 1593 - DNA, 45 bp, Homo sapiens; identical to SEQ ID NO: 626

SEQ ID NO: 1594 - DNA, 51 bp, Homo sapiens; identical to SEQ ID NO: 442

SEQ ID NO: 1595 - DNA, 36 bp, Homo sapiens; identical to SEQ ID NO: 461

SEQ ID NO: 1596 - DNA, 42 bp, Homo sapiens; identical to SEQ ID NO: 472

SEQ ID NO: 1597 - DNA, 39 bp, Homo sapiens; identical to SEQ ID NO: 474

SEQ ID NO: 1598 - DNA, 51 bp, Homo sapiens; identical to SEQ ID NO: 302

SEQ ID NO: 1599 - DNA, 45 bp, Homo sapiens; identical to SEQ ID NO: 506

SEQ ID NO: 1600 - DNA, 42 bp, Homo sapiens; identical to SEQ ID NO: 395

SEQ ID NO: 1601 - DNA, 42 bp, Homo sapiens; identical to SEQ ID NO: 557

SEQ ID NO: 1602 - DNA, 45 bp, Homo sapiens; identical to SEQ ID NO: 509

SEQ ID NO: 1603 - DNA, 45 bp, Homo sapiens; identical to SEQ ID NO: 94

SEQ ID NO: 1604 - DNA, 42 bp, Homo sapiens; identical to SEQ ID NO: 511

SEQ ID NO: 1605 - DNA, 42 bp, Homo sapiens; identical to SEQ ID NO: 262

SEQ ID NO: 1606 - DNA, 42 bp, Homo sapiens; identical to SEQ ID NO: 9

SEQ ID NO: 1607 - DNA, 48 bp, Homo sapiens; identical to SEQ ID NO: 399

SEQ ID NO: 1608 - DNA, 45 bp, Homo sapiens; identical to SEQ ID NO: 10

SEQ ID NO: 1609 - DNA, 48 bp, Homo sapiens; identical to SEQ ID NO: 15

SEQ ID NO: 1610 - DNA, 51 bp, Homo sapiens; identical to SEQ ID NO: 126

SEQ ID NO: 1611 - DNA, 39 bp, Homo sapiens; identical to SEQ ID NO: 514

SEQ ID NO: 1612 - DNA, 45 bp, Homo sapiens; identical to SEQ ID NO: 299

SEQ ID NO: 1613 - DNA, 36 bp, Homo sapiens; identical to SEQ ID NO: 81

SEQ ID NO: 1614 - DNA, 42 bp, Homo sapiens; identical to SEQ ID NO: 84

SEQ ID NO: 1615 - DNA, 48 bp, Homo sapiens; identical to SEQ ID NO: 402

SEQ ID NO: 1616 - DNA, 48 bp, Homo sapiens; identical to SEQ ID NO: 409

SEQ ID NO: 1617 - DNA, 42 bp, Homo sapiens; identical to SEQ ID NO: 229

SEQ ID NO: 1618 - DNA, 48 bp, Homo sapiens; identical to SEQ ID NO: 523

SEQ ID NO: 1619 - DNA, 42 bp, Homo sapiens; identical to SEQ ID NO: 111

SEQ ID NO: 1620 - DNA, 36 bp, Homo sapiens; identical to SEQ ID NO: 526

SEQ ID NO: 1621 - DNA, 39 bp, Homo sapiens; identical to SEQ ID NO: 527

SEQ ID NO: 1622 - DNA, 54 bp, Homo sapiens; identical to SEQ ID NO: 323

SEQ ID NO: 1623 - DNA, 51 bp, Homo sapiens; identical to SEQ ID NO: 528

SEQ ID NO: 1624 - DNA, 54 bp, Homo sapiens; identical to SEQ ID NO: 52

SEQ ID NO: 1625 - DNA, 42 bp, Homo sapiens; identical to SEQ ID NO: 325

SEQ ID NO: 1626 - DNA, 42 bp, Homo sapiens; identical to SEQ ID NO: 325

SEQ ID NO: 1627 - DNA, 45 bp, Homo sapiens; identical to SEQ ID NO: 584

SEQ ID NO: 1628 - DNA, 36 bp, Homo sapiens; identical to SEQ ID NO: 248

SEQ ID NO: 1629 - DNA, 39 bp, Homo sapiens; identical to SEQ ID NO: 384

SEQ ID NO: 1630 - DNA, 39 bp, Homo sapiens; identical to SEQ ID NO: 384

SEQ ID NO: 1631 - DNA, 51 bp, Homo sapiens; identical to SEQ ID NO: 104

SEQ ID NO: 1632 - DNA, 51 bp, Homo sapiens; identical to SEQ ID NO: 104

SEQ ID NO: 1633 - DNA, 39 bp, Homo sapiens; identical to SEQ ID NO: 156

SEQ ID NO: 1634 - DNA, 45 bp, Homo sapiens; identical to SEQ ID NO: 589

SEQ ID NO: 1635 - DNA, 54 bp, Homo sapiens; identical to SEQ ID NO: 45

SEQ ID NO: 1636 - DNA, 51 bp, Homo sapiens; identical to SEQ ID NO: 46

SEQ ID NO: 1637 - DNA, 33 bp, Homo sapiens; identical to SEQ ID NO: 592

SEQ ID NO: 1638 - DNA, 51 bp, Homo sapiens; identical to SEQ ID NO: 313

SEQ ID NO: 1639 - DNA, 42 bp, Homo sapiens; identical to SEQ ID NO: 594

SEQ ID NO: 1640 - DNA, 39 bp, Homo sapiens; identical to SEQ ID NO: 283

SEQ ID NO: 1641 - DNA, 42 bp, Homo sapiens; identical to SEQ ID NO: 293

SEQ ID NO: 1642 - DNA, 48 bp, Homo sapiens; identical to SEQ ID NO: 545

SEQ ID NO: 1643 - DNA, 48 bp, Homo sapiens; identical to SEQ ID NO: 545

SEQ ID NO: 1644 - DNA, 33 bp, Homo sapiens; identical to SEQ ID NO: 176

SEQ ID NO: 1645 - DNA, 45 bp, Homo sapiens; identical to SEQ ID NO: 600

SEQ ID NO: 1646 - DNA, 45 bp, Homo sapiens; identical to SEQ ID NO: 600

SEQ ID NO: 1647 - DNA, 45 bp, Homo sapiens; identical to SEQ ID NO: 165

SEQ ID NO: 1648 - DNA, 57 bp, Homo sapiens; identical to SEQ ID NO: 256

SEQ ID NO: 1649 - DNA, 45 bp, Homo sapiens; identical to SEQ ID NO: 257

SEQ ID NO: 1650 - DNA, 45 bp, Homo sapiens; identical to SEQ ID NO: 624

SEQ ID NO: 1651 - DNA, 36 bp, Homo sapiens; identical to SEQ ID NO: 625

SEQ ID NO: 1652 - DNA, 48 bp, Homo sapiens; identical to SEQ ID NO: 451

SEQ ID NO: 1653 - DNA, 39 bp, Homo sapiens; identical to SEQ ID NO: 614

SEQ ID NO: 1654 - DNA, 36 bp, Homo sapiens; identical to SEQ ID NO: 615

SEQ ID NO: 1655 - DNA, 39 bp, Homo sapiens; identical to SEQ ID NO: 303

SEQ ID NO: 1656 - DNA, 36 bp, Homo sapiens; identical to SEQ ID NO: 392

SEQ ID NO: 1657 - DNA, 45 bp, Homo sapiens
tgtgccagcattttatccacgggaaacaatcacccccagcttttt

SEQ ID NO: 1658 - DNA, 45 bp, Homo sapiens; identical to SEQ ID NO: 1

SEQ ID NO: 1659 - DNA, 39 bp, Homo sapiens; identical to SEQ ID NO: 149

SEQ ID NO: 1660 - DNA, 33 bp, Homo sapiens; identical to SEQ ID NO: 394

SEQ ID NO: 1661 - DNA, 39 bp, Homo sapiens; identical to SEQ ID NO: 173

SEQ ID NO: 1662 - DNA, 45 bp, Homo sapiens; identical to SEQ ID NO: 398

SEQ ID NO: 1663 - DNA, 45 bp, Homo sapiens; identical to SEQ ID NO: 223

SEQ ID NO: 1664 - DNA, 45 bp, Homo sapiens; identical to SEQ ID NO: 95

SEQ ID NO: 1665 - DNA, 42 bp, Homo sapiens; identical to SEQ ID NO: 267

SEQ ID NO: 1666 - DNA, 43 bp, Homo sapiens
tgccagcagtcacggacaggccgcttggtatggctacaccttc

SEQ ID NO: 1667 - DNA, 54 bp, Homo sapiens; identical to SEQ ID NO: 182

SEQ ID NO: 1668 - DNA, 45 bp, Homo sapiens; identical to SEQ ID NO: 406

SEQ ID NO: 1669 - DNA, 48 bp, Homo sapiens; identical to SEQ ID NO: 408

SEQ ID NO: 1670 - DNA, 60 bp, Homo sapiens; identical to SEQ ID NO: 109

SEQ ID NO: 1671 - DNA, 48 bp, Homo sapiens; identical to SEQ ID NO: 230

SEQ ID NO: 1672 - DNA, 39 bp, Homo sapiens; identical to SEQ ID NO: 317

SEQ ID NO: 1673 - DNA, 51 bp, Homo sapiens; identical to SEQ ID NO: 86

SEQ ID NO: 1674 - DNA, 42 bp, Homo sapiens; identical to SEQ ID NO: 347

SEQ ID NO: 1675 - DNA, 45 bp, Homo sapiens; identical to SEQ ID NO: 524

SEQ ID NO: 1676 - DNA, 48 bp, Homo sapiens; identical to SEQ ID NO: 233

SEQ ID NO: 1677 - DNA, 48 bp, Homo sapiens; identical to SEQ ID NO: 234

SEQ ID NO: 1678 - DNA, 42 bp, Homo sapiens; identical to SEQ ID NO: 235

SEQ ID NO: 1679 - DNA, 42 bp, Homo sapiens; identical to SEQ ID NO: 525

SEQ ID NO: 1680 - DNA, 45 bp, Homo sapiens; identical to SEQ ID NO: 99

SEQ ID NO: 1681 - DNA, 45 bp, Homo sapiens; identical to SEQ ID NO: 237

SEQ ID NO: 1682 - DNA, 48 bp, Homo sapiens; identical to SEQ ID NO: 240

SEQ ID NO: 1683 - DNA, 42 bp, Homo sapiens; identical to SEQ ID NO: 114

SEQ ID NO: 1684 - DNA, 42 bp, Homo sapiens; identical to SEQ ID NO: 349

SEQ ID NO: 1685 - DNA, 42 bp, Homo sapiens; identical to SEQ ID NO: 312

SEQ ID NO: 1686 - DNA, 45 bp, Homo sapiens; identical to SEQ ID NO: 533

SEQ ID NO: 1687 - DNA, 42 bp, Homo sapiens; identical to SEQ ID NO: 200

SEQ ID NO: 1688 - DNA, 36 bp, Homo sapiens; identical to SEQ ID NO: 201

SEQ ID NO: 1689 - DNA, 39 bp, Homo sapiens; identical to SEQ ID NO: 536

SEQ ID NO: 1690 - DNA, 36 bp, Homo sapiens; identical to SEQ ID NO: 251

SEQ ID NO: 1691 - DNA, 48 bp, Homo sapiens; identical to SEQ ID NO: 538

SEQ ID NO: 1692 - DNA, 51 bp, Homo sapiens; identical to SEQ ID NO: 219

SEQ ID NO: 1693 - DNA, 51 bp, Homo sapiens; identical to SEQ ID NO: 219

SEQ ID NO: 1694 - DNA, 48 bp, Homo sapiens; identical to SEQ ID NO: 588

SEQ ID NO: 1695 - DNA, 45 bp, Homo sapiens; identical to SEQ ID NO: 387

SEQ ID NO: 1696 - DNA, 39 bp, Homo sapiens; identical to SEQ ID NO: 213

SEQ ID NO: 1697 - DNA, 39 bp, Homo sapiens; identical to SEQ ID NO: 54

SEQ ID NO: 1698 - DNA, 42 bp, Homo sapiens; identical to SEQ ID NO: 71

SEQ ID NO: 1699 - DNA, 48 bp, Homo sapiens; identical to SEQ ID NO: 42

SEQ ID NO: 1700 - DNA, 42 bp, Homo sapiens; identical to SEQ ID NO: 48

SEQ ID NO: 1701 - DNA, 45 bp, Homo sapiens; identical to SEQ ID NO: 355

SEQ ID NO: 1702 - DNA, 42 bp, Homo sapiens; identical to SEQ ID NO: 329

SEQ ID NO: 1703 - DNA, 42 bp, Homo sapiens; identical to SEQ ID NO: 91

SEQ ID NO: 1704 - DNA, 42 bp, Homo sapiens; identical to SEQ ID NO: 137

SEQ ID NO: 1705 - DNA, 36 bp, Homo sapiens; identical to SEQ ID NO: 593

SEQ ID NO: 1706 - DNA, 48 bp, Homo sapiens; identical to SEQ ID NO: 253

SEQ ID NO: 1707 - DNA, 48 bp, Homo sapiens; identical to SEQ ID NO: 254

SEQ ID NO: 1708 - DNA, 33 bp, Homo sapiens; identical to SEQ ID NO: 543

SEQ ID NO: 1709 - DNA, 45 bp, Homo sapiens; identical to SEQ ID NO: 597

SEQ ID NO: 1710 - DNA, 33 bp, Homo sapiens; identical to SEQ ID NO: 598

SEQ ID NO: 1711 - DNA, 33 bp, Homo sapiens; identical to SEQ ID NO: 598

SEQ ID NO: 1712 - DNA, 42 bp, Homo sapiens; identical to SEQ ID NO: 158

SEQ ID NO: 1713 - DNA, 42 bp, Homo sapiens; identical to SEQ ID NO: 159

SEQ ID NO: 1714 - DNA, 42 bp, Homo sapiens; identical to SEQ ID NO: 162

SEQ ID NO: 1715 - DNA, 48 bp, Homo sapiens; identical to SEQ ID NO: 164

SEQ ID NO: 1716 - DNA, 45 bp, Homo sapiens; identical to SEQ ID NO: 142

SEQ ID NO: 1717 - DNA, 36 bp, Homo sapiens; identical to SEQ ID NO: 358

SEQ ID NO: 1718 - DNA, 45 bp, Homo sapiens; identical to SEQ ID NO: 429

SEQ ID NO: 1719 - DNA, 39 bp, Homo sapiens; identical to SEQ ID NO: 431

SEQ ID NO: 1720 - DNA, 45 bp, Homo sapiens; identical to SEQ ID NO: 30

SEQ ID NO: 1721 - DNA, 42 bp, Homo sapiens; identical to SEQ ID NO: 488

SEQ ID NO: 1722 - DNA, 42 bp, Homo sapiens; identical to SEQ ID NO: 375

SEQ ID NO: 1723 - DNA, 45 bp, Homo sapiens; identical to SEQ ID NO: 379

SEQ ID NO: 1724 - DNA, 42 bp, Homo sapiens; identical to SEQ ID NO: 606

SEQ ID NO: 1725 - DNA, 45 bp, Homo sapiens; identical to SEQ ID NO: 434

SEQ ID NO: 1726 - DNA, 45 bp, Homo sapiens; identical to SEQ ID NO: 435

SEQ ID NO: 1727 - DNA, 42 bp, Homo sapiens; identical to SEQ ID NO: 445

SEQ ID NO: 1728 - DNA, 45 bp, Homo sapiens; identical to SEQ ID NO: 449

SEQ ID NO: 1729 - DNA, 42 bp, Homo sapiens; identical to SEQ ID NO: 455

SEQ ID NO: 1730 - DNA, 45 bp, Homo sapiens; identical to SEQ ID NO: 460

SEQ ID NO: 1731 - DNA, 39 bp, Homo sapiens; identical to SEQ ID NO: 481

SEQ ID NO: 1732 - DNA, 39 bp, Homo sapiens; identical to SEQ ID NO: 390

SEQ ID NO: 1733 - DNA, 51 bp, Homo sapiens; identical to SEQ ID NO: 502

SEQ ID NO: 1734 - DNA, 54 bp, Homo sapiens; identical to SEQ ID NO: 339

SEQ ID NO: 1735 - DNA, 42 bp, Homo sapiens; identical to SEQ ID NO: 172

SEQ ID NO: 1736 - DNA, 36 bp, Homo sapiens; identical to SEQ ID NO: 150

SEQ ID NO: 1737 - DNA, 36 bp, Homo sapiens; identical to SEQ ID NO: 150

SEQ ID NO: 1738 - DNA, 42 bp, Homo sapiens; identical to SEQ ID NO: 151

SEQ ID NO: 1739 - DNA, 57 bp, Homo sapiens; identical to SEQ ID NO: 556

SEQ ID NO: 1740 - DNA, 42 bp, Homo sapiens; identical to SEQ ID NO: 396

SEQ ID NO: 1741 - DNA, 42 bp, Homo sapiens; identical to SEQ ID NO: 264

SEQ ID NO: 1742 - DNA, 45 bp, Homo sapiens; identical to SEQ ID NO: 515

SEQ ID NO: 1743 - DNA, 48 bp, Homo sapiens; identical to SEQ ID NO: 82

SEQ ID NO: 1744 - DNA, 39 bp, Homo sapiens; identical to SEQ ID NO: 572

SEQ ID NO: 1745 - DNA, 45 bp, Homo sapiens; identical to SEQ ID NO: 404

SEQ ID NO: 1746 - DNA, 48 bp, Homo sapiens; identical to SEQ ID NO: 413

SEQ ID NO: 1747 - DNA, 42 bp, Homo sapiens; identical to SEQ ID NO: 295

SEQ ID NO: 1748 - DNA, 42 bp, Homo sapiens; identical to SEQ ID NO: 227

SEQ ID NO: 1749 - DNA, 45 bp, Homo sapiens; identical to SEQ ID NO: 85

SEQ ID NO: 1750 - DNA, 54 bp, Homo sapiens; identical to SEQ ID NO: 117

SEQ ID NO: 1751 - DNA, 51 bp, Homo sapiens; identical to SEQ ID NO: 335

SEQ ID NO: 1752 - DNA, 39 bp, Homo sapiens; identical to SEQ ID NO: 191

SEQ ID NO: 1753 - DNA, 48 bp, Homo sapiens; identical to SEQ ID NO: 366

SEQ ID NO: 1754 - DNA, 48 bp, Homo sapiens; identical to SEQ ID NO: 321

SEQ ID NO: 1755 - DNA, 45 bp, Homo sapiens; identical to SEQ ID NO: 322

SEQ ID NO: 1756 - DNA, 42 bp, Homo sapiens; identical to SEQ ID NO: 112

SEQ ID NO: 1757 - DNA, 42 bp, Homo sapiens; identical to SEQ ID NO: 113

SEQ ID NO: 1758 - DNA, 39 bp, Homo sapiens; identical to SEQ ID NO: 98

SEQ ID NO: 1759 - DNA, 39 bp, Homo sapiens; identical to SEQ ID NO: 337

SEQ ID NO: 1760 - DNA, 45 bp, Homo sapiens; identical to SEQ ID NO: 241

SEQ ID NO: 1761 - DNA, 45 bp, Homo sapiens; identical to SEQ ID NO: 324

SEQ ID NO: 1762 - DNA, 42 bp, Homo sapiens; identical to SEQ ID NO: 581

SEQ ID NO: 1763 - DNA, 54 bp, Homo sapiens; identical to SEQ ID NO: 582

SEQ ID NO: 1764 - DNA, 39 bp, Homo sapiens; identical to SEQ ID NO: 532

SEQ ID NO: 1765 - DNA, 45 bp, Homo sapiens; identical to SEQ ID NO: 351

SEQ ID NO: 1766 - DNA, 33 bp, Homo sapiens; identical to SEQ ID NO: 587

SEQ ID NO: 1767 - DNA, 42 bp, Homo sapiens; identical to SEQ ID NO: 38

SEQ ID NO: 1768 - DNA, 45 bp, Homo sapiens; identical to SEQ ID NO: 276

SEQ ID NO: 1769 - DNA, 48 bp, Homo sapiens; identical to SEQ ID NO: 208

SEQ ID NO: 1770 - DNA, 39 bp, Homo sapiens; identical to SEQ ID NO: 352

SEQ ID NO: 1771 - DNA, 42 bp, Homo sapiens; identical to SEQ ID NO: 136

SEQ ID NO: 1772 - DNA, 45 bp, Homo sapiens; identical to SEQ ID NO: 76

SEQ ID NO: 1773 - DNA, 48 bp, Homo sapiens; identical to SEQ ID NO: 73

SEQ ID NO: 1774 - DNA, 48 bp, Homo sapiens; identical to SEQ ID NO: 43

SEQ ID NO: 1775 - DNA, 45 bp, Homo sapiens; identical to SEQ ID NO: 422

SEQ ID NO: 1776 - DNA, 48 bp, Homo sapiens; identical to SEQ ID NO: 353

SEQ ID NO: 1777 - DNA, 48 bp, Homo sapiens; identical to SEQ ID NO: 369

SEQ ID NO: 1778 - DNA, 51 bp, Homo sapiens; identical to SEQ ID NO: 255

SEQ ID NO: 1779 - DNA, 51 bp, Homo sapiens; identical to SEQ ID NO: 284

SEQ ID NO: 1780 - DNA, 39 bp, Homo sapiens; identical to SEQ ID NO: 287

SEQ ID NO: 1781 - DNA, 48 bp, Homo sapiens; identical to SEQ ID NO: 290

SEQ ID NO: 1782 - DNA, 42 bp, Homo sapiens; identical to SEQ ID NO: 291

SEQ ID NO: 1783 - DNA, 51 bp, Homo sapiens; identical to SEQ ID NO: 27

SEQ ID NO: 1784 - DNA, 45 bp, Homo sapiens; identical to SEQ ID NO: 139

SEQ ID NO: 1785 - DNA, 45 bp, Homo sapiens; identical to SEQ ID NO: 334

SEQ ID NO: 1786 - DNA, 39 bp, Homo sapiens; identical to SEQ ID NO: 430

SEQ ID NO: 1787 - DNA, 39 bp, Homo sapiens; identical to SEQ ID NO: 430

SEQ ID NO: 1788 - DNA, 39 bp, Homo sapiens; identical to SEQ ID NO: 430

SEQ ID NO: 1789 - DNA, 39 bp, Homo sapiens; identical to SEQ ID NO: 430

SEQ ID NO: 1790 - DNA, 48 bp, Homo sapiens; identical to SEQ ID NO: 489

SEQ ID NO: 1791 - DNA, 48 bp, Homo sapiens; identical to SEQ ID NO: 627

SEQ ID NO: 1792 - DNA, 48 bp, Homo sapiens; identical to SEQ ID NO: 628

SEQ ID NO: 1793 - DNA, 51 bp, Homo sapiens; identical to SEQ ID NO: 433

SEQ ID NO: 1794 - DNA, 42 bp, Homo sapiens; identical to SEQ ID NO: 436

SEQ ID NO: 1795 - DNA, 39 bp, Homo sapiens; identical to SEQ ID NO: 438

SEQ ID NO: 1796 - DNA, 45 bp, Homo sapiens; identical to SEQ ID NO: 450

SEQ ID NO: 1797 - DNA, 45 bp, Homo sapiens; identical to SEQ ID NO: 454

SEQ ID NO: 1798 - DNA, 42 bp, Homo sapiens; identical to SEQ ID NO: 457

SEQ ID NO: 1799 - DNA, 42 bp, Homo sapiens; identical to SEQ ID NO: 458

SEQ ID NO: 1800 - DNA, 42 bp, Homo sapiens; identical to SEQ ID NO: 459

SEQ ID NO: 1801 - DNA, 39 bp, Homo sapiens; identical to SEQ ID NO: 464

SEQ ID NO: 1802 - DNA, 45 bp, Homo sapiens; identical to SEQ ID NO: 465

SEQ ID NO: 1803 - DNA, 42 bp, Homo sapiens; identical to SEQ ID NO: 469

SEQ ID NO: 1804 - DNA, 45 bp, Homo sapiens; identical to SEQ ID NO: 475

SEQ ID NO: 1805 - DNA, 45 bp, Homo sapiens; identical to SEQ ID NO: 475

SEQ ID NO: 1806 - DNA, 36 bp, Homo sapiens; identical to SEQ ID NO: 479

SEQ ID NO: 1807 - DNA, 45 bp, Homo sapiens; identical to SEQ ID NO: 480

SEQ ID NO: 1808 - DNA, 45 bp, Homo sapiens; identical to SEQ ID NO: 613

SEQ ID NO: 1809 - DNA, 48 bp, Homo sapiens; identical to SEQ ID NO: 619

SEQ ID NO: 1810 - DNA, 36 bp, Homo sapiens; identical to SEQ ID NO: 620

SEQ ID NO: 1811 - DNA, 45 bp, Homo sapiens; identical to SEQ ID NO: 501

SEQ ID NO: 1812 - DNA, 45 bp, Homo sapiens; identical to SEQ ID NO: 306

SEQ ID NO: 1813 - DNA, 48 bp, Homo sapiens; identical to SEQ ID NO: 307

SEQ ID NO: 1814 - DNA, 45 bp, Homo sapiens; identical to SEQ ID NO: 503

SEQ ID NO: 1815 - DNA, 33 bp, Homo sapiens; identical to SEQ ID NO: 2

SEQ ID NO: 1816 - DNA, 42 bp, Homo sapiens; identical to SEQ ID NO: 554

SEQ ID NO: 1817 - DNA, 39 bp, Homo sapiens; identical to SEQ ID NO: 508

SEQ ID NO: 1818 - DNA, 39 bp, Homo sapiens; identical to SEQ ID NO: 221

SEQ ID NO: 1819 - DNA, 39 bp, Homo sapiens; identical to SEQ ID NO: 33

SEQ ID NO: 1820 - DNA, 39 bp, Homo sapiens; identical to SEQ ID NO: 560

SEQ ID NO: 1821 - DNA, 42 bp, Homo sapiens; identical to SEQ ID NO: 265

SEQ ID NO: 1822 - DNA, 45 bp, Homo sapiens; identical to SEQ ID NO: 19

SEQ ID NO: 1823 - DNA, 54 bp, Homo sapiens; identical to SEQ ID NO: 79

SEQ ID NO: 1824 - DNA, 36 bp, Homo sapiens; identical to SEQ ID NO: 315

SEQ ID NO: 1825 - DNA, 48 bp, Homo sapiens; identical to SEQ ID NO: 563

SEQ ID NO: 1826 - DNA, 42 bp, Homo sapiens; identical to SEQ ID NO: 344

SEQ ID NO: 1827 - DNA, 42 bp, Homo sapiens; identical to SEQ ID NO: 517

SEQ ID NO: 1828 - DNA, 42 bp, Homo sapiens; identical to SEQ ID NO: 570

SEQ ID NO: 1829 - DNA, 48 bp, Homo sapiens; identical to SEQ ID NO: 519

SEQ ID NO: 1830 - DNA, 39 bp, Homo sapiens; identical to SEQ ID NO: 268

SEQ ID NO: 1831 - DNA, 51 bp, Homo sapiens; identical to SEQ ID NO: 269

SEQ ID NO: 1832 - DNA, 45 bp, Homo sapiens; identical to SEQ ID NO: 401

SEQ ID NO: 1833 - DNA, 33 bp, Homo sapiens; identical to SEQ ID NO: 573

SEQ ID NO: 1834 - DNA, 39 bp, Homo sapiens; identical to SEQ ID NO: 405

SEQ ID NO: 1835 - DNA, 39 bp, Homo sapiens; identical to SEQ ID NO: 410

SEQ ID NO: 1836 - DNA, 42 bp, Homo sapiens; identical to SEQ ID NO: 414

SEQ ID NO: 1837 - DNA, 45 bp, Homo sapiens; identical to SEQ ID NO: 520

SEQ ID NO: 1838 - DNA, 48 bp, Homo sapiens; identical to SEQ ID NO: 319

SEQ ID NO: 1839 - DNA, 39 bp, Homo sapiens; identical to SEQ ID NO: 336

SEQ ID NO: 1840 - DNA, 48 bp, Homo sapiens; identical to SEQ ID NO: 194

SEQ ID NO: 1841 - DNA, 48 bp, Homo sapiens; identical to SEQ ID NO: 100

SEQ ID NO: 1842 - DNA, 42 bp, Homo sapiens; identical to SEQ ID NO: 242

SEQ ID NO: 1843 - DNA, 45 bp, Homo sapiens; identical to SEQ ID NO: 243

SEQ ID NO: 1844 - DNA, 45 bp, Homo sapiens; identical to SEQ ID NO: 244

SEQ ID NO: 1845 - DNA, 51 bp, Homo sapiens; identical to SEQ ID NO: 195

SEQ ID NO: 1846 - DNA, 39 bp, Homo sapiens; identical to SEQ ID NO: 273

SEQ ID NO: 1847 - DNA, 45 bp, Homo sapiens; identical to SEQ ID NO: 101

SEQ ID NO: 1848 - DNA, 48 bp, Homo sapiens; identical to SEQ ID NO: 326

SEQ ID NO: 1849 - DNA, 39 bp, Homo sapiens; identical to SEQ ID NO: 418

SEQ ID NO: 1850 - DNA, 45 bp, Homo sapiens; identical to SEQ ID NO: 350

SEQ ID NO: 1851 - DNA, 51 bp, Homo sapiens
tgtgccagctcacctgcagggcgaacctactcctacgagcagtacttcttc

SEQ ID NO: 1852 - DNA, 39 bp, Homo sapiens; identical to SEQ ID NO: 537

SEQ ID NO: 1853 - DNA, 36 bp, Homo sapiens; identical to SEQ ID NO: 186

SEQ ID NO: 1854 - DNA, 60 bp, Homo sapiens; identical to SEQ ID NO: 217

SEQ ID NO: 1855 - DNA, 48 bp, Homo sapiens; identical to SEQ ID NO: 388

SEQ ID NO: 1856 - DNA, 45 bp, Homo sapiens; identical to SEQ ID NO: 277

SEQ ID NO: 1857 - DNA, 48 bp, Homo sapiens; identical to SEQ ID NO: 59

SEQ ID NO: 1858 - DNA, 42 bp, Homo sapiens; identical to SEQ ID NO: 62

SEQ ID NO: 1859 - DNA, 45 bp, Homo sapiens; identical to SEQ ID NO: 41

SEQ ID NO: 1860 - DNA, 45 bp, Homo sapiens; identical to SEQ ID NO: 281

SEQ ID NO: 1861 - DNA, 36 bp, Homo sapiens; identical to SEQ ID NO: 65

SEQ ID NO: 1862 - DNA, 39 bp, Homo sapiens; identical to SEQ ID NO: 44

SEQ ID NO: 1863 - DNA, 45 bp, Homo sapiens; identical to SEQ ID NO: 368

SEQ ID NO: 1864 - DNA, 39 bp, Homo sapiens; identical to SEQ ID NO: 210

SEQ ID NO: 1865 - DNA, 48 bp, Homo sapiens; identical to SEQ ID NO: 354

SEQ ID NO: 1866 - DNA, 42 bp, Homo sapiens; identical to SEQ ID NO: 591

SEQ ID NO: 1867 - DNA, 33 bp, Homo sapiens; identical to SEQ ID NO: 211

SEQ ID NO: 1868 - DNA, 51 bp, Homo sapiens; identical to SEQ ID NO: 107

SEQ ID NO: 1869 - DNA, 42 bp, Homo sapiens; identical to SEQ ID NO: 541

SEQ ID NO: 1870 - DNA, 60 bp, Homo sapiens
tgtgccagcagctcgcctttctcaggactagcgggaacctactcctacgagcagtacttc

SEQ ID NO: 1871 - DNA, 54 bp, Homo sapiens; identical to SEQ ID NO: 423

SEQ ID NO: 1872 - DNA, 36 bp, Homo sapiens; identical to SEQ ID NO: 595

SEQ ID NO: 1873 - DNA, 42 bp, Homo sapiens; identical to SEQ ID NO: 285

SEQ ID NO: 1874 - DNA, 48 bp, Homo sapiens; identical to SEQ ID NO: 599

SEQ ID NO: 1875 - DNA, 42 bp, Homo sapiens; identical to SEQ ID NO: 170

SEQ ID NO: 1876 - DNA, 57 bp, Homo sapiens; identical to SEQ ID NO: 425

SEQ ID NO: 1877 - DNA, 42 bp, Homo sapiens; identical to SEQ ID NO: 50

SEQ ID NO: 1878 - DNA, 48 bp, Homo sapiens; identical to SEQ ID NO: 359

SEQ ID NO: 1879 - DNA, 48 bp, Homo sapiens; identical to SEQ ID NO: 491

SEQ ID NO: 1880 - DNA, 48 bp, Homo sapiens; identical to SEQ ID NO: 376

SEQ ID NO: 1881 - DNA, 45 bp, Homo sapiens; identical to SEQ ID NO: 378

SEQ ID NO: 1882 - DNA, 33 bp, Homo sapiens; identical to SEQ ID NO: 360

SEQ ID NO: 1883 - DNA, 36 bp, Homo sapiens; identical to SEQ ID NO: 629

SEQ ID NO: 1884 - DNA, 45 bp, Homo sapiens
tgtgacctgaatgaaacgttccgccggccctacgagcagtacttc

SEQ ID NO: 1885 - DNA, 36 bp, Homo sapiens; identical to SEQ ID NO: 432

SEQ ID NO: 1886 - DNA, 30 bp, Homo sapiens; identical to SEQ ID NO: 608

SEQ ID NO: 1887 - DNA, 36 bp, Homo sapiens; identical to SEQ ID NO: 440

SEQ ID NO: 1888 - DNA, 39 bp, Homo sapiens; identical to SEQ ID NO: 443

SEQ ID NO: 1889 - DNA, 45 bp, Homo sapiens; identical to SEQ ID NO: 453

SEQ ID NO: 1890 - DNA, 45 bp, Homo sapiens; identical to SEQ ID NO: 482

SEQ ID NO: 1891 - DNA, 39 bp, Homo sapiens; identical to SEQ ID NO: 610

SEQ ID NO: 1892 - DNA, 39 bp, Homo sapiens; identical to SEQ ID NO: 610

SEQ ID NO: 1893 - DNA, 39 bp, Homo sapiens; identical to SEQ ID NO: 610

SEQ ID NO: 1894 - DNA, 39 bp, Homo sapiens; identical to SEQ ID NO: 610

SEQ ID NO: 1895 - DNA, 39 bp, Homo sapiens; identical to SEQ ID NO: 621

SEQ ID NO: 1896 - DNA, 42 bp, Homo sapiens; identical to SEQ ID NO: 555

SEQ ID NO: 1897 - DNA, 42 bp, Homo sapiens; identical to SEQ ID NO: 555

SEQ ID NO: 1898 - DNA, 36 bp, Homo sapiens; identical to SEQ ID NO: 558

SEQ ID NO: 1899 - DNA, 48 bp, Homo sapiens; identical to SEQ ID NO: 498

SEQ ID NO: 1900 - DNA, 48 bp, Homo sapiens
tgcgccagcagcgagagacaggggaatatctactccgagcagtacttt

SEQ ID NO: 1901 - DNA, 48 bp, Homo sapiens; identical to SEQ ID NO: 266

SEQ ID NO: 1902 - DNA, 42 bp, Homo sapiens; identical to SEQ ID NO: 564

SEQ ID NO: 1903 - DNA, 42 bp, Homo sapiens; identical to SEQ ID NO: 564

SEQ ID NO: 1904 - DNA, 42 bp, Homo sapiens; identical to SEQ ID NO: 564

SEQ ID NO: 1905 - DNA, 39 bp, Homo sapiens; identical to SEQ ID NO: 566

SEQ ID NO: 1906 - DNA, 42 bp, Homo sapiens; identical to SEQ ID NO: 567

SEQ ID NO: 1907 - DNA, 48 bp, Homo sapiens; identical to SEQ ID NO: 224

SEQ ID NO: 1908 - DNA, 45 bp, Homo sapiens; identical to SEQ ID NO: 407

SEQ ID NO: 1909 - DNA, 36 bp, Homo sapiens; identical to SEQ ID NO: 365

SEQ ID NO: 1910 - DNA, 51 bp, Homo sapiens; identical to SEQ ID NO: 184

SEQ ID NO: 1911 - DNA, 48 bp, Homo sapiens; identical to SEQ ID NO: 103

SEQ ID NO: 1912 - DNA, 48 bp, Homo sapiens; identical to SEQ ID NO: 576

SEQ ID NO: 1913 - DNA, 45 bp, Homo sapiens; identical to SEQ ID NO: 367

SEQ ID NO: 1914 - DNA, 54 bp, Homo sapiens; identical to SEQ ID NO: 529

SEQ ID NO: 1915 - DNA, 48 bp, Homo sapiens; identical to SEQ ID NO: 531

SEQ ID NO: 1916 - DNA, 39 bp, Homo sapiens; identical to SEQ ID NO: 370

SEQ ID NO: 1917 - DNA, 45 bp, Homo sapiens; identical to SEQ ID NO: 204

SEQ ID NO: 1918 - DNA, 45 bp, Homo sapiens; identical to SEQ ID NO: 279

SEQ ID NO: 1919 - DNA, 48 bp, Homo sapiens; identical to SEQ ID NO: 66

SEQ ID NO: 1920 - DNA, 51 bp, Homo sapiens; identical to SEQ ID NO: 540

SEQ ID NO: 1921 - DNA, 45 bp, Homo sapiens; identical to SEQ ID NO: 252

SEQ ID NO: 1922 - DNA, 45 bp, Homo sapiens; identical to SEQ ID NO: 331

SEQ ID NO: 1923 - DNA, 45 bp, Homo sapiens; identical to SEQ ID NO: 332

SEQ ID NO: 1924 - DNA, 39 bp, Homo sapiens; identical to SEQ ID NO: 26

SEQ ID NO: 1925 - DNA, 39 bp, Homo sapiens; identical to SEQ ID NO: 26

SEQ ID NO: 1926 - DNA, 48 bp, Homo sapiens; identical to SEQ ID NO: 333

SEQ ID NO: 1927 - DNA, 48 bp, Homo sapiens; identical to SEQ ID NO: 333

SEQ ID NO: 1928 - DNA, 48 bp, Homo sapiens; identical to SEQ ID NO: 333

SEQ ID NO: 1929 - DNA, 48 bp, Homo sapiens
tgtgccagcagttgggggggggattctagcacagatacccagtatttt

SEQ ID NO: 1930 - DNA, 48 bp, Homo sapiens; identical to SEQ ID NO: 333

SEQ ID NO: 1931 - DNA, 48 bp, Homo sapiens; identical to SEQ ID NO: 333

SEQ ID NO: 1932 - DNA, 48 bp, Homo sapiens; identical to SEQ ID NO: 333

SEQ ID NO: 1933 - DNA, 48 bp, Homo sapiens; identical to SEQ ID NO: 333

SEQ ID NO: 1934 - DNA, 48 bp, Homo sapiens; identical to SEQ ID NO: 333

SEQ ID NO: 1935 - DNA, 48 bp, Homo sapiens; identical to SEQ ID NO: 333

SEQ ID NO: 1936 - DNA, 48 bp, Homo sapiens; identical to SEQ ID NO: 333

SEQ ID NO: 1937 - DNA, 48 bp, Homo sapiens; identical to SEQ ID NO: 333

SEQ ID NO: 1938 - DNA, 48 bp, Homo sapiens; identical to SEQ ID NO: 333

SEQ ID NO: 1939 - DNA, 48 bp, Homo sapiens; identical to SEQ ID NO: 333

SEQ ID NO: 1940 - DNA, 48 bp, Homo sapiens; identical to SEQ ID NO: 333

SEQ ID NO: 1941 - DNA, 48 bp, Homo sapiens; identical to SEQ ID NO: 333

SEQ ID NO: 1942 - DNA, 48 bp, Homo sapiens; identical to SEQ ID NO: 333

SEQ ID NO: 1943 - DNA, 48 bp, Homo sapiens; identical to SEQ ID NO: 333

SEQ ID NO: 1944 - DNA, 48 bp, Homo sapiens; identical to SEQ ID NO: 333

SEQ ID NO: 1945 - DNA, 48 bp, Homo sapiens; identical to SEQ ID NO: 333

SEQ ID NO: 1946 - DNA, 48 bp, Homo sapiens; identical to SEQ ID NO: 333

SEQ ID NO: 1947 - DNA, 48 bp, Homo sapiens; identical to SEQ ID NO: 333

SEQ ID NO: 1948 - DNA, 48 bp, Homo sapiens; identical to SEQ ID NO: 333

SEQ ID NO: 1949 - DNA, 42 bp, Homo sapiens; identical to SEQ ID NO: 92

SEQ ID NO: 1950 - DNA, 48 bp, Homo sapiens; identical to SEQ ID NO: 171

SEQ ID NO: 1951 - DNA, 39 bp, Homo sapiens; identical to SEQ ID NO: 630

SEQ ID NO: 1952 - DNA, 42 bp, Homo sapiens; identical to SEQ ID NO: 631

SEQ ID NO: 1953 - DNA, 39 bp, Homo sapiens; identical to SEQ ID NO: 483

SEQ ID NO: 1954 - DNA, 51 bp, Homo sapiens; identical to SEQ ID NO: 622

SEQ ID NO: 1955 - DNA, 51 bp, Homo sapiens; identical to SEQ ID NO: 309

SEQ ID NO: 1956 - DNA, 39 bp, Homo sapiens; identical to SEQ ID NO: 552

SEQ ID NO: 1957 - DNA, 42 bp, Homo sapiens; identical to SEQ ID NO: 340

SEQ ID NO: 1958 - DNA, 42 bp, Homo sapiens; identical to SEQ ID NO: 340

SEQ ID NO: 1959 - DNA, 42 bp, Homo sapiens; identical to SEQ ID NO: 340

SEQ ID NO: 1960 - DNA, 42 bp, Homo sapiens; identical to SEQ ID NO: 340

SEQ ID NO: 1961 - DNA, 42 bp, Homo sapiens; identical to SEQ ID NO: 341

SEQ ID NO: 1962 - DNA, 42 bp, Homo sapiens; identical to SEQ ID NO: 7

SEQ ID NO: 1963 - DNA, 42 bp, Homo sapiens; identical to SEQ ID NO: 122

SEQ ID NO: 1964 - DNA, 42 bp, Homo sapiens; identical to SEQ ID NO: 122

SEQ ID NO: 1965 - DNA, 45 bp, Homo sapiens; identical to SEQ ID NO: 260

SEQ ID NO: 1966 - DNA, 45 bp, Homo sapiens; identical to SEQ ID NO: 8

SEQ ID NO: 1967 - DNA, 45 bp, Homo sapiens; identical to SEQ ID NO: 11

SEQ ID NO: 1968 - DNA, 45 bp, Homo sapiens; identical to SEQ ID NO: 11

SEQ ID NO: 1969 - DNA, 45 bp, Homo sapiens; identical to SEQ ID NO: 11

SEQ ID NO: 1970 - DNA, 45 bp, Homo sapiens; identical to SEQ ID NO: 11

SEQ ID NO: 1971 - DNA, 45 bp, Homo sapiens; identical to SEQ ID NO: 12

SEQ ID NO: 1972 - DNA, 45 bp, Homo sapiens; identical to SEQ ID NO: 12

SEQ ID NO: 1973 - DNA, 45 bp, Homo sapiens; identical to SEQ ID NO: 108

SEQ ID NO: 1974 - DNA, 45 bp, Homo sapiens; identical to SEQ ID NO: 16

SEQ ID NO: 1975 - DNA, 45 bp, Homo sapiens; identical to SEQ ID NO: 17

SEQ ID NO: 1976 - DNA, 45 bp, Homo sapiens; identical to SEQ ID NO: 17

SEQ ID NO: 1977 - DNA, 45 bp, Homo sapiens; identical to SEQ ID NO: 17

SEQ ID NO: 1978 - DNA, 45 bp, Homo sapiens; identical to SEQ ID NO: 17

SEQ ID NO: 1979 - DNA, 45 bp, Homo sapiens; identical to SEQ ID NO: 17

SEQ ID NO: 1980 - DNA, 45 bp, Homo sapiens; identical to SEQ ID NO: 17

SEQ ID NO: 1981 - DNA, 45 bp, Homo sapiens
tgtgccagcagtgaagggggagggggccaagagacccagtacttc

SEQ ID NO: 1982 - DNA, 45 bp, Homo sapiens; identical to SEQ ID NO: 17

SEQ ID NO: 1983 - DNA, 45 bp, Homo sapiens; identical to SEQ ID NO: 18

SEQ ID NO: 1984 - DNA, 45 bp, Homo sapiens; identical to SEQ ID NO: 18

SEQ ID NO: 1985 - DNA, 42 bp, Homo sapiens; identical to SEQ ID NO: 316

SEQ ID NO: 1986 - DNA, 42 bp, Homo sapiens; identical to SEQ ID NO: 569

SEQ ID NO: 1987 - DNA, 42 bp, Homo sapiens; identical to SEQ ID NO: 34

SEQ ID NO: 1988 - DNA, 45 bp, Homo sapiens
tgtgccagcagtcacctccagggttayggaaacaccatatatttt

SEQ ID NO: 1989 - DNA, 48 bp, Homo sapiens; identical to SEQ ID NO: 272

SEQ ID NO: 1990 - DNA, 42 bp, Homo sapiens; identical to SEQ ID NO: 190

SEQ ID NO: 1991 - DNA, 48 bp, Homo sapiens; identical to SEQ ID NO: 110

SEQ ID NO: 1992 - DNA, 48 bp, Homo sapiens; identical to SEQ ID NO: 577

SEQ ID NO: 1993 - DNA, 48 bp, Homo sapiens; identical to SEQ ID NO: 577

SEQ ID NO: 1994 - DNA, 48 bp, Homo sapiens; identical to SEQ ID NO: 577

SEQ ID NO: 1995 - DNA, 48 bp, Homo sapiens; identical to SEQ ID NO: 97

SEQ ID NO: 1996 - DNA, 42 bp, Homo sapiens; identical to SEQ ID NO: 579

SEQ ID NO: 1997 - DNA, 42 bp, Homo sapiens; identical to SEQ ID NO: 197

SEQ ID NO: 1998 - DNA, 48 bp, Homo sapiens; identical to SEQ ID NO: 37

SEQ ID NO: 1999 - DNA, 48 bp, Homo sapiens; identical to SEQ ID NO: 37

SEQ ID NO: 2000 - DNA, 48 bp, Homo sapiens; identical to SEQ ID NO: 37

SEQ ID NO: 2001 - DNA, 48 bp, Homo sapiens; identical to SEQ ID NO: 37

SEQ ID NO: 2002 - DNA, 48 bp, Homo sapiens; identical to SEQ ID NO: 37

SEQ ID NO: 2003 - DNA, 48 bp, Homo sapiens; identical to SEQ ID NO: 37

SEQ ID NO: 2004 - DNA, 48 bp, Homo sapiens; identical to SEQ ID NO: 37

SEQ ID NO: 2005 - DNA, 48 bp, Homo sapiens; identical to SEQ ID NO: 37

SEQ ID NO: 2006 - DNA, 45 bp, Homo sapiens; identical to SEQ ID NO: 61

SEQ ID NO: 2007 - DNA, 51 bp, Homo sapiens; identical to SEQ ID NO: 372

SEQ ID NO: 2008 - DNA, 54 bp, Homo sapiens; identical to SEQ ID NO: 209

SEQ ID NO: 2009 - DNA, 42 bp, Homo sapiens; identical to SEQ ID NO: 590

SEQ ID NO: 2010 - DNA, 45 bp, Homo sapiens; identical to SEQ ID NO: 206

SEQ ID NO: 2011 - DNA, 45 bp, Homo sapiens; identical to SEQ ID NO: 206

SEQ ID NO: 2012 - DNA, 45 bp, Homo sapiens; identical to SEQ ID NO: 49

SEQ ID NO: 2013 - DNA, 45 bp, Homo sapiens; identical to SEQ ID NO: 49

SEQ ID NO: 2014 - DNA, 45 bp, Homo sapiens; identical to SEQ ID NO: 49

SEQ ID NO: 2015 - DNA, 39 bp, Homo sapiens; identical to SEQ ID NO: 546

SEQ ID NO: 2016 - DNA, 42 bp, Homo sapiens; identical to SEQ ID NO: 168

SEQ ID NO: 2017 - DNA, 48 bp, Homo sapiens; identical to SEQ ID NO: 428

SEQ ID NO: 2018 - DNA, 33 bp, Homo sapiens; identical to SEQ ID NO: 632

SEQ ID NO: 2019 - DNA, 48 bp, Homo sapiens; identical to SEQ ID NO: 467

SEQ ID NO: 2020 - DNA, 33 bp, Homo sapiens; identical to SEQ ID NO: 617

SEQ ID NO: 2021 - DNA, 33 bp, Homo sapiens; identical to SEQ ID NO: 618

SEQ ID NO: 2022 - DNA, 45 bp, Homo sapiens; identical to SEQ ID NO: 363

SEQ ID NO: 2023 - DNA, 45 bp, Homo sapiens; identical to SEQ ID NO: 496

SEQ ID NO: 2024 - DNA, 39 bp, Homo sapiens; identical to SEQ ID NO: 342

SEQ ID NO: 2025 - DNA, 48 bp, Homo sapiens; identical to SEQ ID NO: 124

SEQ ID NO: 2026 - DNA, 45 bp, Homo sapiens; identical to SEQ ID NO: 127

SEQ ID NO: 2027 - DNA, 42 bp, Homo sapiens; identical to SEQ ID NO: 129

SEQ ID NO: 2028 - DNA, 36 bp, Homo sapiens; identical to SEQ ID NO: 345

SEQ ID NO: 2029 - DNA, 54 bp, Homo sapiens; identical to SEQ ID NO: 183

SEQ ID NO: 2030 - DNA, 42 bp, Homo sapiens; identical to SEQ ID NO: 226

SEQ ID NO: 2031 - DNA, 39 bp, Homo sapiens; identical to SEQ ID NO: 51

SEQ ID NO: 2032 - DNA, 48 bp, Homo sapiens; identical to SEQ ID NO: 411

SEQ ID NO: 2033 - DNA, 54 bp, Homo sapiens; identical to SEQ ID NO: 484

SEQ ID NO: 2034 - DNA, 54 bp, Homo sapiens; identical to SEQ ID NO: 318

SEQ ID NO: 2035 - DNA, 54 bp, Homo sapiens; identical to SEQ ID NO: 318

SEQ ID NO: 2036 - DNA, 54 bp, Homo sapiens; identical to SEQ ID NO: 318

SEQ ID NO: 2037 - DNA, 54 bp, Homo sapiens; identical to SEQ ID NO: 318

SEQ ID NO: 2038 - DNA, 39 bp, Homo sapiens; identical to SEQ ID NO: 193

SEQ ID NO: 2039 - DNA, 39 bp, Homo sapiens; identical to SEQ ID NO: 348

SEQ ID NO: 2040 - DNA, 45 bp, Homo sapiens; identical to SEQ ID NO: 246

SEQ ID NO: 2041 - DNA, 45 bp, Homo sapiens; identical to SEQ ID NO: 246

SEQ ID NO: 2042 - DNA, 45 bp, Homo sapiens; identical to SEQ ID NO: 155

SEQ ID NO: 2043 - DNA, 45 bp, Homo sapiens; identical to SEQ ID NO: 419

SEQ ID NO: 2044 - DNA, 45 bp, Homo sapiens; identical to SEQ ID NO: 174

SEQ ID NO: 2045 - DNA, 45 bp, Homo sapiens; identical to SEQ ID NO: 174

SEQ ID NO: 2046 - DNA, 45 bp, Homo sapiens; identical to SEQ ID NO: 174

SEQ ID NO: 2047 - DNA, 45 bp, Homo sapiens; identical to SEQ ID NO: 174

SEQ ID NO: 2048 - DNA, 42 bp, Homo sapiens; identical to SEQ ID NO: 249

SEQ ID NO: 2049 - DNA, 42 bp, Homo sapiens; identical to SEQ ID NO: 249

SEQ ID NO: 2050 - DNA, 42 bp, Homo sapiens; identical to SEQ ID NO: 249

SEQ ID NO: 2051 - DNA, 42 bp, Homo sapiens; identical to SEQ ID NO: 249

SEQ ID NO: 2052 - DNA, 39 bp, Homo sapiens; identical to SEQ ID NO: 250

SEQ ID NO: 2053 - DNA, 42 bp, Homo sapiens; identical to SEQ ID NO: 386

SEQ ID NO: 2054 - DNA, 45 bp, Homo sapiens; identical to SEQ ID NO: 420

SEQ ID NO: 2055 - DNA, 39 bp, Homo sapiens; identical to SEQ ID NO: 58

SEQ ID NO: 2056 - DNA, 33 bp, Homo sapiens; identical to SEQ ID NO: 296

SEQ ID NO: 2057 - DNA, 60 bp, Homo sapiens; identical to SEQ ID NO: 47

SEQ ID NO: 2058 - DNA, 60 bp, Homo sapiens; identical to SEQ ID NO: 47

SEQ ID NO: 2059 - DNA, 60 bp, Homo sapiens; identical to SEQ ID NO: 47

SEQ ID NO: 2060 - DNA, 60 bp, Homo sapiens; identical to SEQ ID NO: 47

SEQ ID NO: 2061 - DNA, 45 bp, Homo sapiens; identical to SEQ ID NO: 67

SEQ ID NO: 2062 - DNA, 42 bp, Homo sapiens; identical to SEQ ID NO: 115

SEQ ID NO: 2063 - DNA, 45 bp, Homo sapiens; identical to SEQ ID NO: 130

SEQ ID NO: 2064 - DNA, 51 bp, Homo sapiens; identical to SEQ ID NO: 102

SEQ ID NO: 2065 - DNA, 42 bp, Homo sapiens; identical to SEQ ID NO: 175

SEQ ID NO: 2066 - DNA, 45 bp, Homo sapiens; identical to SEQ ID NO: 157

SEQ ID NO: 2067 - DNA, 45 bp, Homo sapiens; identical to SEQ ID NO: 389

SEQ ID NO: 2068 - DNA, 45 bp, Homo sapiens; identical to SEQ ID NO: 389

SEQ ID NO: 2069 - DNA, 48 bp, Homo sapiens; identical to SEQ ID NO: 131

SEQ ID NO: 2070 - DNA, 42 bp, Homo sapiens; identical to SEQ ID NO: 292

SEQ ID NO: 2071 - DNA, 54 bp, Homo sapiens; identical to SEQ ID NO: 338

SEQ ID NO: 2072 - DNA, 42 bp, Homo sapiens; identical to SEQ ID NO: 547

SEQ ID NO: 2073 - DNA, 33 bp, Homo sapiens; identical to SEQ ID NO: 160

SEQ ID NO: 2074 - DNA, 33 bp, Homo sapiens; identical to SEQ ID NO: 500

SEQ ID NO: 2075 - DNA, 33 bp, Homo sapiens; identical to SEQ ID NO: 500

SEQ ID NO: 2076 - DNA, 51 bp, Homo sapiens; identical to SEQ ID NO: 605

SEQ ID NO: 2077 - DNA, 42 bp, Homo sapiens; identical to SEQ ID NO: 373

SEQ ID NO: 2078 - DNA, 45 bp, Homo sapiens; identical to SEQ ID NO: 380

SEQ ID NO: 2079 - DNA, 36 bp, Homo sapiens; identical to SEQ ID NO: 494

SEQ ID NO: 2080 - DNA, 42 bp, Homo sapiens; identical to SEQ ID NO: 633

SEQ ID NO: 2081 - DNA, 39 bp, Homo sapiens; identical to SEQ ID NO: 634

SEQ ID NO: 2082 - DNA, 39 bp, Homo sapiens; identical to SEQ ID NO: 607

SEQ ID NO: 2083 - DNA, 42 bp, Homo sapiens; identical to SEQ ID NO: 462

SEQ ID NO: 2084 - DNA, 42 bp, Homo sapiens; identical to SEQ ID NO: 462

SEQ ID NO: 2085 - DNA, 42 bp, Homo sapiens; identical to SEQ ID NO: 462

SEQ ID NO: 2086 - DNA, 42 bp, Homo sapiens; identical to SEQ ID NO: 462

SEQ ID NO: 2087 - DNA, 42 bp, Homo sapiens; identical to SEQ ID NO: 466

SEQ ID NO: 2088 - DNA, 45 bp, Homo sapiens; identical to SEQ ID NO: 308

SEQ ID NO: 2089 - DNA, 57 bp, Homo sapiens; identical to SEQ ID NO: 362

SEQ ID NO: 2090 - DNA, 51 bp, Homo sapiens; identical to SEQ ID NO: 258

SEQ ID NO: 2091 - DNA, 51 bp, Homo sapiens; identical to SEQ ID NO: 553

SEQ ID NO: 2092 - DNA, 48 bp, Homo sapiens; identical to SEQ ID NO: 4

SEQ ID NO: 2093 - DNA, 36 bp, Homo sapiens; identical to SEQ ID NO: 507

SEQ ID NO: 2094 - DNA, 36 bp, Homo sapiens; identical to SEQ ID NO: 497

SEQ ID NO: 2095 - DNA, 45 bp, Homo sapiens; identical to SEQ ID NO: 512

SEQ ID NO: 2096 - DNA, 39 bp, Homo sapiens; identical to SEQ ID NO: 261

SEQ ID NO: 2097 - DNA, 42 bp, Homo sapiens; identical to SEQ ID NO: 513

SEQ ID NO: 2098 - DNA, 42 bp, Homo sapiens; identical to SEQ ID NO: 513

SEQ ID NO: 2099 - DNA, 42 bp, Homo sapiens; identical to SEQ ID NO: 513

SEQ ID NO: 2100 - DNA, 45 bp, Homo sapiens; identical to SEQ ID NO: 561

SEQ ID NO: 2101 - DNA, 45 bp, Homo sapiens; identical to SEQ ID NO: 263

SEQ ID NO: 2102 - DNA, 42 bp, Homo sapiens; identical to SEQ ID NO: 21

SEQ ID NO: 2103 - DNA, 39 bp, Homo sapiens; identical to SEQ ID NO: 562

SEQ ID NO: 2104 - DNA, 42 bp, Homo sapiens; identical to SEQ ID NO: 343

SEQ ID NO: 2105 - DNA, 42 bp, Homo sapiens; identical to SEQ ID NO: 565

SEQ ID NO: 2106 - DNA, 45 bp, Homo sapiens; identical to SEQ ID NO: 516

SEQ ID NO: 2107 - DNA, 39 bp, Homo sapiens; identical to SEQ ID NO: 133

SEQ ID NO: 2108 - DNA, 45 bp, Homo sapiens; identical to SEQ ID NO: 571

SEQ ID NO: 2109 - DNA, 48 bp, Homo sapiens; identical to SEQ ID NO: 69

SEQ ID NO: 2110 - DNA, 39 bp, Homo sapiens; identical to SEQ ID NO: 153

SEQ ID NO: 2111 - DNA, 42 bp, Homo sapiens; identical to SEQ ID NO: 521

SEQ ID NO: 2112 - DNA, 42 bp, Homo sapiens; identical to SEQ ID NO: 96

SEQ ID NO: 2113 - DNA, 45 bp, Homo sapiens; identical to SEQ ID NO: 575

SEQ ID NO: 2114 - DNA, 45 bp, Homo sapiens; identical to SEQ ID NO: 320

SEQ ID NO: 2115 - DNA, 45 bp, Homo sapiens; identical to SEQ ID NO: 134

SEQ ID NO: 2116 - DNA, 42 bp, Homo sapiens; identical to SEQ ID NO: 178

SEQ ID NO: 2117 - DNA, 39 bp, Homo sapiens; identical to SEQ ID NO: 154

SEQ ID NO: 2118 - DNA, 42 bp, Homo sapiens; identical to SEQ ID NO: 239

SEQ ID NO: 2119 - DNA, 39 bp, Homo sapiens; identical to SEQ ID NO: 207

SEQ ID NO: 2120 - DNA, 48 bp, Homo sapiens; identical to SEQ ID NO: 196

SEQ ID NO: 2121 - DNA, 45 bp, Homo sapiens; identical to SEQ ID NO: 179

SEQ ID NO: 2122 - DNA, 42 bp, Homo sapiens; identical to SEQ ID NO: 185

SEQ ID NO: 2123 - DNA, 36 bp, Homo sapiens; identical to SEQ ID NO: 180

SEQ ID NO: 2124 - DNA, 45 bp, Homo sapiens; identical to SEQ ID NO: 215

SEQ ID NO: 2125 - DNA, 42 bp, Homo sapiens; identical to SEQ ID NO: 199

SEQ ID NO: 2126 - DNA, 51 bp, Homo sapiens; identical to SEQ ID NO: 247

SEQ ID NO: 2127 - DNA, 36 bp, Homo sapiens; identical to SEQ ID NO: 530

SEQ ID NO: 2128 - DNA, 48 bp, Homo sapiens; identical to SEQ ID NO: 88

SEQ ID NO: 2129 - DNA, 51 bp, Homo sapiens; identical to SEQ ID NO: 89

SEQ ID NO: 2130 - DNA, 51 bp, Homo sapiens; identical to SEQ ID NO: 89

SEQ ID NO: 2131 - DNA, 45 bp, Homo sapiens; identical to SEQ ID NO: 275

SEQ ID NO: 2132 - DNA, 45 bp, Homo sapiens; identical to SEQ ID NO: 586

SEQ ID NO: 2133 - DNA, 36 bp, Homo sapiens; identical to SEQ ID NO: 216

SEQ ID NO: 2134 - DNA, 33 bp, Homo sapiens; identical to SEQ ID NO: 385

SEQ ID NO: 2135 - DNA, 48 bp, Homo sapiens; identical to SEQ ID NO: 534

SEQ ID NO: 2136 - DNA, 45 bp, Homo sapiens; identical to SEQ ID NO: 535

SEQ ID NO: 2137 - DNA, 51 bp, Homo sapiens; identical to SEQ ID NO: 421

SEQ ID NO: 2138 - DNA, 42 bp, Homo sapiens; identical to SEQ ID NO: 327

SEQ ID NO: 2139 - DNA, 45 bp, Homo sapiens; identical to SEQ ID NO: 278

SEQ ID NO: 2140 - DNA, 45 bp, Homo sapiens; identical to SEQ ID NO: 90

SEQ ID NO: 2141 - DNA, 36 bp, Homo sapiens; identical to SEQ ID NO: 55

SEQ ID NO: 2142 - DNA, 48 bp, Homo sapiens; identical to SEQ ID NO: 60

SEQ ID NO: 2143 - DNA, 42 bp, Homo sapiens; identical to SEQ ID NO: 72

SEQ ID NO: 2144 - DNA, 42 bp, Homo sapiens; identical to SEQ ID NO: 330

SEQ ID NO: 2145 - DNA, 36 bp, Homo sapiens; identical to SEQ ID NO: 181

SEQ ID NO: 2146 - DNA, 45 bp, Homo sapiens; identical to SEQ ID NO: 205

SEQ ID NO: 2147 - DNA, 36 bp, Homo sapiens; identical to SEQ ID NO: 596

SEQ ID NO: 2148 - DNA, 60 bp, Homo sapiens; identical to SEQ ID NO: 189

SEQ ID NO: 2149 - DNA, 60 bp, Homo sapiens; identical to SEQ ID NO: 189

SEQ ID NO: 2150 - DNA, 36 bp, Homo sapiens; identical to SEQ ID NO: 544

SEQ ID NO: 2151 - DNA, 42 bp, Homo sapiens; identical to SEQ ID NO: 288

SEQ ID NO: 2152 - DNA, 45 bp, Homo sapiens; identical to SEQ ID NO: 220

SEQ ID NO: 2153 - DNA, 45 bp, Homo sapiens; identical to SEQ ID NO: 161

SEQ ID NO: 2154 - DNA, 33 bp, Homo sapiens; identical to SEQ ID NO: 163

SEQ ID NO: 2155 - DNA, 45 bp, Homo sapiens; identical to SEQ ID NO: 177

SEQ ID NO: 2156 - DNA, 36 bp, Homo sapiens; identical to SEQ ID NO: 212

SEQ ID NO: 2157 - DNA, 36 bp, Homo sapiens; identical to SEQ ID NO: 212

SEQ ID NO: 2158 - DNA, 48 bp, Homo sapiens; identical to SEQ ID NO: 167

SEQ ID NO: 2159 - DNA, 42 bp, Homo sapiens; identical to SEQ ID NO: 548

SEQ ID NO: 2160 - DNA, 48 bp, Homo sapiens; identical to SEQ ID NO: 603

SEQ ID NO: 2161 - DNA, 42 bp, Homo sapiens; identical to SEQ ID NO: 604

SEQ ID NO: 2162 - DNA, 48 bp, Homo sapiens; identical to SEQ ID NO: 311

SEQ ID NO: 2163 - DNA, 39 bp, Homo sapiens; identical to SEQ ID NO: 492

SEQ ID NO: 2164 - DNA, 42 bp, Homo sapiens; identical to SEQ ID NO: 635

SEQ ID NO: 2165 - DNA, 36 bp, Homo sapiens; identical to SEQ ID NO: 439

SEQ ID NO: 2166 - DNA, 42 bp, Homo sapiens; identical to SEQ ID NO: 444

SEQ ID NO: 2167 - DNA, 42 bp, Homo sapiens; identical to SEQ ID NO: 446

SEQ ID NO: 2168 - DNA, 48 bp, Homo sapiens; identical to SEQ ID NO: 448

SEQ ID NO: 2169 - DNA, 39 bp, Homo sapiens; identical to SEQ ID NO: 452

SEQ ID NO: 2170 - DNA, 39 bp, Homo sapiens; identical to SEQ ID NO: 470

SEQ ID NO: 2171 - DNA, 39 bp, Homo sapiens; identical to SEQ ID NO: 471

SEQ ID NO: 2172 - DNA, 42 bp, Homo sapiens; identical to SEQ ID NO: 611

SEQ ID NO: 2173 - DNA, 42 bp, Homo sapiens; identical to SEQ ID NO: 616

SEQ ID NO: 2174 - DNA, 39 bp, Homo sapiens; identical to SEQ ID NO: 623

SEQ ID NO: 2175 - DNA, 45 bp, Homo sapiens; identical to SEQ ID NO: 551

SEQ ID NO: 2176 - DNA, 36 bp, Homo sapiens; identical to SEQ ID NO: 301

SEQ ID NO: 2177 - DNA, 51 bp, Homo sapiens; identical to SEQ ID NO: 305

SEQ ID NO: 2178 - DNA, 39 bp, Homo sapiens; identical to SEQ ID NO: 391

SEQ ID NO: 2179 - DNA, 45 bp, Homo sapiens; identical to SEQ ID NO: 361

SEQ ID NO: 2180 - DNA, 43 bp, Homo sapiens
tgcctccccccccctcaacaggggcgaaaatgagcagttcttc

SEQ ID NO: 2181 - DNA, 39 bp, Homo sapiens; identical to SEQ ID NO: 93

SEQ ID NO: 2182 - DNA, 36 bp, Homo sapiens; identical to SEQ ID NO: 5

SEQ ID NO: 2183 - DNA, 48 bp, Homo sapiens; identical to SEQ ID NO: 152

SEQ ID NO: 2184 - DNA, 45 bp, Homo sapiens; identical to SEQ ID NO: 397

SEQ ID NO: 2185 - DNA, 45 bp, Homo sapiens; identical to SEQ ID NO: 314

SEQ ID NO: 2186 - DNA, 33 bp, Homo sapiens; identical to SEQ ID NO: 222

SEQ ID NO: 2187 - DNA, 33 bp, Homo sapiens; identical to SEQ ID NO: 222

SEQ ID NO: 2188 - DNA, 36 bp, Homo sapiens; identical to SEQ ID NO: 298

SEQ ID NO: 2189 - DNA, 48 bp, Homo sapiens; identical to SEQ ID NO: 13

SEQ ID NO: 2190 - DNA, 45 bp, Homo sapiens; identical to SEQ ID NO: 214

SEQ ID NO: 2191 - DNA, 48 bp, Homo sapiens; identical to SEQ ID NO: 225

SEQ ID NO: 2192 - DNA, 39 bp, Homo sapiens; identical to SEQ ID NO: 300

SEQ ID NO: 2193 - DNA, 51 bp, Homo sapiens; identical to SEQ ID NO: 270

SEQ ID NO: 2194 - DNA, 42 bp, Homo sapiens; identical to SEQ ID NO: 23

SEQ ID NO: 2195 - DNA, 42 bp, Homo sapiens; identical to SEQ ID NO: 23

SEQ ID NO: 2196 - DNA, 33 bp, Homo sapiens; identical to SEQ ID NO: 574

SEQ ID NO: 2197 - DNA, 36 bp, Homo sapiens; identical to SEQ ID NO: 522

SEQ ID NO: 2198 - DNA, 45 bp, Homo sapiens; identical to SEQ ID NO: 36

SEQ ID NO: 2199 - DNA, 54 bp, Homo sapiens; identical to SEQ ID NO: 231

SEQ ID NO: 2200 - DNA, 39 bp, Homo sapiens; identical to SEQ ID NO: 192

SEQ ID NO: 2201 - DNA, 48 bp, Homo sapiens; identical to SEQ ID NO: 118

SEQ ID NO: 2202 - DNA, 45 bp, Homo sapiens; identical to SEQ ID NO: 232

SEQ ID NO: 2203 - DNA, 48 bp, Homo sapiens; identical to SEQ ID NO: 236

SEQ ID NO: 2204 - DNA, 39 bp, Homo sapiens; identical to SEQ ID NO: 578

SEQ ID NO: 2205 - DNA, 42 bp, Homo sapiens; identical to SEQ ID NO: 580

SEQ ID NO: 2206 - DNA, 42 bp, Homo sapiens; identical to SEQ ID NO: 583

SEQ ID NO: 2207 - DNA, 42 bp, Homo sapiens; identical to SEQ ID NO: 583

SEQ ID NO: 2208 - DNA, 45 bp, Homo sapiens; identical to SEQ ID NO: 202

SEQ ID NO: 2209 - DNA, 45 bp, Homo sapiens; identical to SEQ ID NO: 203

SEQ ID NO: 2210 - DNA, 45 bp, Homo sapiens; identical to SEQ ID NO: 203

SEQ ID NO: 2211 - DNA, 45 bp, Homo sapiens; identical to SEQ ID NO: 203

SEQ ID NO: 2212 - DNA, 48 bp, Homo sapiens; identical to SEQ ID NO: 218

SEQ ID NO: 2213 - DNA, 48 bp, Homo sapiens; identical to SEQ ID NO: 328

SEQ ID NO: 2214 - DNA, 48 bp, Homo sapiens; identical to SEQ ID NO: 539

SEQ ID NO: 2215 - DNA, 45 bp, Homo sapiens; identical to SEQ ID NO: 70

SEQ ID NO: 2216 - DNA, 45 bp, Homo sapiens; identical to SEQ ID NO: 70

SEQ ID NO: 2217 - DNA, 42 bp, Homo sapiens; identical to SEQ ID NO: 56

SEQ ID NO: 2218 - DNA, 42 bp, Homo sapiens; identical to SEQ ID NO: 63

SEQ ID NO: 2219 - DNA, 42 bp, Homo sapiens; identical to SEQ ID NO: 63

SEQ ID NO: 2220 - DNA, 39 bp, Homo sapiens; identical to SEQ ID NO: 106

SEQ ID NO: 2221 - DNA, 36 bp, Homo sapiens; identical to SEQ ID NO: 356

SEQ ID NO: 2222 - DNA, 39 bp, Homo sapiens; identical to SEQ ID NO: 188

SEQ ID NO: 2223 - DNA, 54 bp, Homo sapiens; identical to SEQ ID NO: 289

SEQ ID NO: 2224 - DNA, 45 bp, Homo sapiens; identical to SEQ ID NO: 28

SEQ ID NO: 2225 - DNA, 42 bp, Homo sapiens; identical to SEQ ID NO: 141

SEQ ID NO: 2226 - DNA, 51 bp, Homo sapiens; identical to SEQ ID NO: 169

SEQ ID NO: 2227 - DNA, 48 bp, Homo sapiens; identical to SEQ ID NO: 144

SEQ ID NO: 2228 - DNA, 36 bp, Homo sapiens; identical to SEQ ID NO: 602

SEQ ID NO: 2229 - DNA, 39 bp, Homo sapiens; identical to SEQ ID NO: 426

SEQ ID NO: 2230 - DNA, 39 bp, Homo sapiens; identical to SEQ ID NO: 148

SEQ ID NO: 2231 - DNA, 48 bp, Homo sapiens; identical to SEQ ID NO: 427

SEQ ID NO: 2232 - DNA, 42 bp, Homo sapiens; identical to SEQ ID NO: 549

SEQ ID NO: 2233 - DNA, 42 bp, Homo sapiens; identical to SEQ ID NO: 549

SEQ ID NO: 2234 - DNA, 42 bp, Homo sapiens; identical to SEQ ID NO: 310

SEQ ID NO: 2235 - DNA, 42 bp, Homo sapiens; identical to SEQ ID NO: 29

SEQ ID NO: 2236 - DNA, 51 bp, Homo sapiens; identical to SEQ ID NO: 31

SEQ ID NO: 2237 - DNA, 48 bp, Homo sapiens; identical to SEQ ID NO: 490

SEQ ID NO: 2238 - DNA, 51 bp, Homo sapiens; identical to SEQ ID NO: 493

SEQ ID NO: 2239 - DNA, 42 bp, Homo sapiens; identical to SEQ ID NO: 495

SEQ ID NO: 2240 - DNA, 36 bp, Homo sapiens; identical to SEQ ID NO: 636

SEQ ID NO: 2241 - DNA, 45 bp, Homo sapiens; identical to SEQ ID NO: 468

SEQ ID NO: 2242 - DNA, 45 bp, Homo sapiens; identical to SEQ ID NO: 468

SEQ ID NO: 2243 - DNA, 36 bp, Homo sapiens; identical to SEQ ID NO: 473

SEQ ID NO: 2244 - DNA, 36 bp, Homo sapiens; identical to SEQ ID NO: 473

SEQ ID NO: 2245 - DNA, 36 bp, Homo sapiens; identical to SEQ ID NO: 473

SEQ ID NO: 2246 - DNA, 42 bp, Homo sapiens; identical to SEQ ID NO: 476

SEQ ID NO: 2247 - DNA, 51 bp, Homo sapiens; identical to SEQ ID NO: 477

SEQ ID NO: 2248 - DNA, 45 bp, Homo sapiens; identical to SEQ ID NO: 612

SEQ ID NO: 2249 - DNA, 45 bp, Homo sapiens; identical to SEQ ID NO: 120

SEQ ID NO: 2250 - DNA, 39 bp, Homo sapiens; identical to SEQ ID NO: 121

SEQ ID NO: 2251 - DNA, 36 bp, Homo sapiens; identical to SEQ ID NO: 510

SEQ ID NO: 2252 - DNA, 45 bp, Homo sapiens; identical to SEQ ID NO: 123

SEQ ID NO: 2253 - DNA, 45 bp, Homo sapiens; identical to SEQ ID NO: 128

SEQ ID NO: 2254 - DNA, 45 bp, Homo sapiens; identical to SEQ ID NO: 20

SEQ ID NO: 2255 - DNA, 45 bp, Homo sapiens; identical to SEQ ID NO: 22

SEQ ID NO: 2256 - DNA, 45 bp, Homo sapiens; identical to SEQ ID NO: 22

SEQ ID NO: 2257 - DNA, 39 bp, Homo sapiens; identical to SEQ ID NO: 568

SEQ ID NO: 2258 - DNA, 45 bp, Homo sapiens; identical to SEQ ID NO: 346

SEQ ID NO: 2259 - DNA, 51 bp, Homo sapiens; identical to SEQ ID NO: 294

SEQ ID NO: 2260 - DNA, 48 bp, Homo sapiens; identical to SEQ ID NO: 400

SEQ ID NO: 2261 - DNA, 39 bp, Homo sapiens; identical to SEQ ID NO: 412

SEQ ID NO: 2262 - DNA, 48 bp, Homo sapiens; identical to SEQ ID NO: 415

SEQ ID NO: 2263 - DNA, 36 bp, Homo sapiens; identical to SEQ ID NO: 24

SEQ ID NO: 2264 - DNA, 36 bp, Homo sapiens; identical to SEQ ID NO: 585

SEQ ID NO: 2265 - DNA, 45 bp, Homo sapiens; identical to SEQ ID NO: 499

SEQ ID NO: 2266 - DNA, 45 bp, Homo sapiens; identical to SEQ ID NO: 77

SEQ ID NO: 2267 - DNA, 51 bp, Homo sapiens; identical to SEQ ID NO: 78

SEQ ID NO: 2268 - DNA, 42 bp, Homo sapiens; identical to SEQ ID NO: 371

SEQ ID NO: 2269 - DNA, 36 bp, Homo sapiens; identical to SEQ ID NO: 357

SEQ ID NO: 2270 - DNA, 39 bp, Homo sapiens; identical to SEQ ID NO: 138

SEQ ID NO: 2271 - DNA, 45 bp, Homo sapiens; identical to SEQ ID NO: 140

SEQ ID NO: 2272 - DNA, 48 bp, Homo sapiens; identical to SEQ ID NO: 143

SEQ ID NO: 2273 - DNA, 48 bp, Homo sapiens; identical to SEQ ID NO: 143

SEQ ID NO: 2274 - DNA, 48 bp, Homo sapiens; identical to SEQ ID NO: 143

SEQ ID NO: 2275 - DNA, 42 bp, Homo sapiens; identical to SEQ ID NO: 145

SEQ ID NO: 2276 - DNA, 42 bp, Homo sapiens; identical to SEQ ID NO: 146

SEQ ID NO: 2277 - DNA, 45 bp, Homo sapiens; identical to SEQ ID NO: 424

SEQ ID NO: 2278 - DNA, 48 bp, Homo sapiens; identical to SEQ ID NO: 147

SEQ ID NO: 2279 - DNA, 42 bp, Homo sapiens; identical to SEQ ID NO: 377

SEQ ID NO: 2280 - DNA, 42 bp, Homo sapiens; identical to SEQ ID NO: 377

SEQ ID NO: 2281 - DNA, 39 bp, Homo sapiens; identical to SEQ ID NO: 381

SEQ ID NO: 2282 - DNA, 39 bp, Homo sapiens; identical to SEQ ID NO: 381

SEQ ID NO: 2283 - DNA, 39 bp, Homo sapiens; identical to SEQ ID NO: 381

SEQ ID NO: 2284 - DNA, 39 bp, Homo sapiens; identical to SEQ ID NO: 382

SEQ ID NO: 2285 - DNA, 45 bp, Homo sapiens; identical to SEQ ID NO: 550

SEQ ID NO: 2286 - DNA, 39 bp, Homo sapiens; identical to SEQ ID NO: 437

SEQ ID NO: 2287 - DNA, 39 bp, Homo sapiens; identical to SEQ ID NO: 441

SEQ ID NO: 2288 - DNA, 39 bp, Homo sapiens; identical to SEQ ID NO: 447

SEQ ID NO: 2289 - DNA, 33 bp, Homo sapiens; identical to SEQ ID NO: 456

SEQ ID NO: 2290 - DNA, 36 bp, Homo sapiens; identical to SEQ ID NO: 463

SEQ ID NO: 2291 - DNA, 45 bp, Homo sapiens; identical to SEQ ID NO: 609

SEQ ID NO: 2292 - DNA, 39 bp, Homo sapiens; identical to SEQ ID NO: 478

SEQ ID NO: 2293 - DNA, 39 bp, Homo sapiens; identical to SEQ ID NO: 478

SEQ ID NO: 2294 - DNA, 39 bp, Homo sapiens; identical to SEQ ID NO: 478

SEQ ID NO: 2295 - protein, 14 aa, Homo sapiens
CAIREDRRSSPLHF

SEQ ID NO: 2296 - protein, 19 aa, Homo sapiens
CASSQDQQGVMVLAQPQHF

SEQ ID NO: 2297 - protein, 13 aa, Homo sapiens
CASGDRENEKLFF

SEQ ID NO: 2298 - protein, 12 aa, Homo sapiens
CASGQGAYEQYF

SEQ ID NO: 2299 - protein, 15 aa, Homo sapiens
CASMGFGSATDTQYF

SEQ ID NO: 2300 - protein, 12 aa, Homo sapiens
CASRGEGLEAFF

SEQ ID NO: 2301 - protein, 13 aa, Homo sapiens
CASRTDGSETQYF

SEQ ID NO: 2302 - protein, 15 aa, Homo sapiens
CASSAGQPGSYEQYF

SEQ ID NO: 2303 - protein, 15 aa, Homo sapiens
CASSEALMTFYEQYF

SEQ ID NO: 2304 - protein, 15 aa, Homo sapiens
CASSEEAGGASGYTF

SEQ ID NO: 2305 - protein, 15 aa, Homo sapiens
CASSFSGSGNIEQFF

SEQ ID NO: 2306 - protein, 16 aa, Homo sapiens
CASSFTLGTGGNEQYF

SEQ ID NO: 2307 - protein, 17 aa, Homo sapiens
CASSIGTGGFFANTQYF

SEQ ID NO: 2308 - protein, 17 aa, Homo sapiens
CASSLALAGGISYEQYF

SEQ ID NO: 2309 - protein, 16 aa, Homo sapiens
CASSLAQGGDTDTQYF

SEQ ID NO: 2310 - protein, 19 aa, Homo sapiens
CASSLGPSLLAEVGNEQFF

SEQ ID NO: 2311 - protein, 14 aa, Homo sapiens
CASSLGQGEEKLFF

SEQ ID NO: 2312 - protein, 14 aa, Homo sapiens
CASSLGTVNTEAFF

SEQ ID NO: 2313 - protein, 13 aa, Homo sapiens
CASSLRANNEQFF

SEQ ID NO: 2314 - protein, 14 aa, Homo sapiens
CASSLSEIRYEQYF

SEQ ID NO: 2315 - protein, 16 aa, Homo sapiens
CASSLSGAPRSDTQYF

SEQ ID NO: 2316 - protein, 16 aa, Homo sapiens
CASSLSLGGESSPLHF

SEQ ID NO: 2317 - protein, 16 aa, Homo sapiens
CASSPDSGKNTGELFF

SEQ ID NO: 2318 - protein, 13 aa, Homo sapiens
CASSPGVSQPQHF

SEQ ID NO: 2319 - protein, 14 aa, Homo sapiens
CASSPPPGGEKLFF

SEQ ID NO: 2320 - protein, 14 aa, Homo sapiens
CASSPQGDWNEQFF

SEQ ID NO: 2321 - protein, 16 aa, Homo sapiens
CASSPQLAERSYEQYF

SEQ ID NO: 2322 - protein, 15 aa, Homo sapiens
CASSPRAGAGGELFF

SEQ ID NO: 2323 - protein, 15 aa, Homo sapiens
CASSPRAGAGGELFF

SEQ ID NO: 2324 - protein, 15 aa, Homo sapiens
CASSPRAGAGGELFF

SEQ ID NO: 2325 - protein, 17 aa, Homo sapiens
CASSPRSPGTSGDEQYF

SEQ ID NO: 2326 - protein, 14 aa, Homo sapiens
CASSPTPRPGELFF

SEQ ID NO: 2327 - protein, 14 aa, Homo sapiens
CASSPWGTGSEQYF

SEQ ID NO: 2328 - protein, 15 aa, Homo sapiens
CASSQGAAGANVLTF

SEQ ID NO: 2329 - protein, 15 aa, Homo sapiens
CASSQGGGEVDEQFF

SEQ ID NO: 2330 - protein, 17 aa, Homo sapiens
CASSQSAPGLVDNEQFF

SEQ ID NO: 2331 - protein, 15 aa, Homo sapiens
CASSQSMTSAETQYF

SEQ ID NO: 2332 - protein, 14 aa, Homo sapiens
CASSSSGTTGELFF

SEQ ID NO: 2333 - protein, 16 aa, Homo sapiens
CASSSSLETGDTEAFF

SEQ ID NO: 2334 - protein, 14 aa, Homo sapiens
CASSSTPTKETQYF

SEQ ID NO: 2335 - protein, 12 aa, Homo sapiens
CASSSYSYEQYF

SEQ ID NO: 2336 - protein, 15 aa, Homo sapiens
CASSVDYRGNQPQHF

SEQ ID NO: 2337 - protein, 15 aa, Homo sapiens
CASSYLSDGTYEQYF

SEQ ID NO: 2338 - protein, 14 aa, Homo sapiens
CASSYRDVAYEQYF

SEQ ID NO: 2339 - protein, 14 aa, Homo sapiens
CASSYRDVAYEQYF

SEQ ID NO: 2340 - protein, 15 aa, Homo sapiens
CASTEPPDRATEAFF

SEQ ID NO: 2341 - protein, 14 aa, Homo sapiens
CASTLDGSNNEQFF

SEQ ID NO: 2342 - protein, 17 aa, Homo sapiens
CATSDEGQGARTGELFF

SEQ ID NO: 2343 - protein, 15 aa, Homo sapiens
CAWSPPGTLTYEQYF

SEQ ID NO: 2344 - protein, 17 aa, Homo sapiens
CSAPGTSGSGGIDTQYF

SEQ ID NO: 2345 - protein, 12 aa, Homo sapiens
CSARFQYNEQFF

SEQ ID NO: 2346 - protein, 14 aa, Homo sapiens
CSARSTGGETEAFF

SEQ ID NO: 2347 - protein, 13 aa, Homo sapiens
CSARTGSTGELFF

SEQ ID NO: 2348 - protein, 17 aa, Homo sapiens
CAIRAGTGGAVGTEAFF

SEQ ID NO: 2349 - protein, 15 aa, Homo sapiens
CASLSREAPLDTQYF

SEQ ID NO: 2350 - protein, 14 aa, Homo sapiens
CASRGQGARNEQFF

SEQ ID NO: 2351 - protein, 14 aa, Homo sapiens
CASRPGQAYNEQFF

SEQ ID NO: 2352 - protein, 15 aa, Homo sapiens
CASRPSWREGGEQYF

SEQ ID NO: 2353 - protein, 15 aa, Homo sapiens
CASRQTGLLTDTQYF

SEQ ID NO: 2354 - protein, 14 aa, Homo sapiens
CASRSGTGTDTQYF

SEQ ID NO: 2355 - protein, 14 aa, Homo sapiens
CASSAPYGGETQYF

SEQ ID NO: 2356 - protein, 14 aa, Homo sapiens
CASSARLNVETQYF

SEQ ID NO: 2357 - protein, 16 aa, Homo sapiens
CASSASGASSYNEQFF

SEQ ID NO: 2358 - protein, 15 aa, Homo sapiens
CASSDAAATNYEQYF

SEQ ID NO: 2359 - protein, 16 aa, Homo sapiens
CASSEDRQRTDETQYF

SEQ ID NO: 2360 - protein, 17 aa, Homo sapiens
CASSEEGGTSAYNEQFF

SEQ ID NO: 2361 - protein, 13 aa, Homo sapiens
CASSEFVQETQYF

SEQ ID NO: 2362 - protein, 15 aa, Homo sapiens
CASSESMGGSQPQHF

SEQ ID NO: 2363 - protein, 12 aa, Homo sapiens
CASSFIEGEQFF

SEQ ID NO: 2364 - protein, 14 aa, Homo sapiens
CASSGGLSGDEQFF

SEQ ID NO: 2365 - protein, 16 aa, Homo sapiens
CASSIGGGRWNNEQFF

SEQ ID NO: 2366 - protein, 16 aa, Homo sapiens
CASSIRGYLSYNEQFF

SEQ ID NO: 2367 - protein, 14 aa, Homo sapiens
CASSLASGQETQYF

SEQ ID NO: 2368 - protein, 16 aa, Homo sapiens
CASSLFGQVGFTEAFF

SEQ ID NO: 2369 - protein, 14 aa, Homo sapiens
CASSLGASRYEQYF

SEQ ID NO: 2370 - protein, 12 aa, Homo sapiens
CASSLHTGELFF

SEQ ID NO: 2371 - protein, 13 aa, Homo sapiens
CASSLIGQIEQFF

SEQ ID NO: 2372 - protein, 18 aa, Homo sapiens
CASSLLLAGGPSTDTQYF

SEQ ID NO: 2373 - protein, 17 aa, Homo sapiens
CASSLLPRQAPGNEQFF

SEQ ID NO: 2374 - protein, 18 aa, Homo sapiens
CASSLTQAGQSPAYEQYF

SEQ ID NO: 2375 - protein, 14 aa, Homo sapiens
CASSLVLGYTEAFF

SEQ ID NO: 2376 - protein, 14 aa, Homo sapiens
CASSLVLGYTEAFF

SEQ ID NO: 2377 - protein, 15 aa, Homo sapiens
CASSLVPGRNTEAFF

SEQ ID NO: 2378 - protein, 12 aa, Homo sapiens
CASSLWDDEQYF

SEQ ID NO: 2379 - protein, 13 aa, Homo sapiens
CASSPEGGPTQYF

SEQ ID NO: 2380 - protein, 13 aa, Homo sapiens
CASSPEGGPTQYF

SEQ ID NO: 2381 - protein, 17 aa, Homo sapiens
CASSPELAGGLLETQYF

SEQ ID NO: 2382 - protein, 17 aa, Homo sapiens
CASSPELAGGLLETQYF

SEQ ID NO: 2383 - protein, 13 aa, Homo sapiens
CASSPSGNIEQYF

SEQ ID NO: 2384 - protein, 15 aa, Homo sapiens
CASSPSPAGAYGYTF

SEQ ID NO: 2385 - protein, 18 aa, Homo sapiens
CASSQSSLAGGPSGELFF

SEQ ID NO: 2386 - protein, 17 aa, Homo sapiens
CASSQTGSPQITDTQYF

SEQ ID NO: 2387 - protein, 11 aa, Homo sapiens
CASSSLGEQYF

SEQ ID NO: 2388 - protein, 17 aa, Homo sapiens
CASSSPGEIQVTYEQYF

SEQ ID NO: 2389 - protein, 14 aa, Homo sapiens
CASSSQDSSYEQYF

SEQ ID NO: 2390 - protein, 13 aa, Homo sapiens
CASSVASPGELFF

SEQ ID NO: 2391 - protein, 14 aa, Homo sapiens
CASSVVSGTGELFF

SEQ ID NO: 2392 - protein, 16 aa, Homo sapiens
CASSWGGGGSIYEQYF

SEQ ID NO: 2393 - protein, 16 aa, Homo sapiens
CASSWGGGGSIYEQYF

SEQ ID NO: 2394 - protein, 11 aa, Homo sapiens
CASSYGHEQYF

SEQ ID NO: 2395 - protein, 15 aa, Homo sapiens
CASSYLDAGNSPLHF

SEQ ID NO: 2396 - protein, 15 aa, Homo sapiens
CASSYLDAGNSPLHF

SEQ ID NO: 2397 - protein, 15 aa, Homo sapiens
CASSYLDRGLGEQYF

SEQ ID NO: 2398 - protein, 19 aa, Homo sapiens
CASTPTGTRLVEVTYEQYF

SEQ ID NO: 2399 - protein, 15 aa, Homo sapiens
CASTPWADSYNEQFF

SEQ ID NO: 2400 - protein, 15 aa, Homo sapiens
CAWSVGFLAGYEQYF

SEQ ID NO: 2401 - protein, 12 aa, Homo sapiens
CAWSVLSDEQFF

SEQ ID NO: 2402 - protein, 16 aa, Homo sapiens
CSARDLSGSEDNEQFF

SEQ ID NO: 2403 - protein, 13 aa, Homo sapiens
CSVEEFTDTEAFF

SEQ ID NO: 2404 - protein, 12 aa, Homo sapiens
CSVEQDTYGYTF

SEQ ID NO: 2405 - protein, 13 aa, Homo sapiens
CAIRDMTRNEQFF

SEQ ID NO: 2406 - protein, 12 aa, Homo sapiens
CASGPPNYGYTF

SEQ ID NO: 2407 - protein, 15 aa, Homo sapiens
CASILSTGNNHPQLF

SEQ ID NO: 2408 - protein, 15 aa, Homo sapiens
CASKPGTTRNNEQFF

SEQ ID NO: 2409 - protein, 13 aa, Homo sapiens
CASLGSGQETQYF

SEQ ID NO: 2410 - protein, 11 aa, Homo sapiens
CASRGAGALHF

SEQ ID NO: 2411 - protein, 13 aa, Homo sapiens
CASRYPQDPGQYF

SEQ ID NO: 2412 - protein, 15 aa, Homo sapiens
CASSARGHSGNTIYF

SEQ ID NO: 2413 - protein, 15 aa, Homo sapiens
CASSFPLSSLETQYF

SEQ ID NO: 2414 - protein, 15 aa, Homo sapiens
CASSFSGGHPMGYTF

SEQ ID NO: 2415 - protein, 14 aa, Homo sapiens
CASSGEGLNYEQYF

SEQ ID NO: 2416 - protein, 15 aa, Homo sapiens
CASSHGQAAWYGYTF

SEQ ID NO: 2417 - protein, 18 aa, Homo sapiens
CASSHGVIWSPDTGELFF

SEQ ID NO: 2418 - protein, 15 aa, Homo sapiens
CASSIQASSYNEQFF

SEQ ID NO: 2419 - protein, 16 aa, Homo sapiens
CASSIRADPAYNEQFF

SEQ ID NO: 2420 - protein, 20 aa, Homo sapiens
CASSLAELGRGGRLHYEQYF

SEQ ID NO: 2421 - protein, 16 aa, Homo sapiens
CASSLAVSGSSDEQYF

SEQ ID NO: 2422 - protein, 13 aa, Homo sapiens
CASSLDFADTQYF

SEQ ID NO: 2423 - protein, 17 aa, Homo sapiens
CASSLDRETLSGNTIYF

SEQ ID NO: 2424 - protein, 14 aa, Homo sapiens
CASSLEGKMVEAFF

SEQ ID NO: 2425 - protein, 15 aa, Homo sapiens
CASSLFQGGPTEAFF

SEQ ID NO: 2426 - protein, 15 aa, Homo sapiens
CASSLGFGLAGDEQF

SEQ ID NO: 2427 - protein, 16 aa, Homo sapiens
CASSLGFGREANVLTF

SEQ ID NO: 2428 - protein, 14 aa, Homo sapiens
CASSLGFGRETQYF

SEQ ID NO: 2429 - protein, 14 aa, Homo sapiens
CASSLGGGWNEQFF

SEQ ID NO: 2430 - protein, 15 aa, Homo sapiens
CASSLGLAGKNEQYF

SEQ ID NO: 2431 - protein, 15 aa, Homo sapiens
CASSLGLGPQNPQHF

SEQ ID NO: 2432 - protein, 16 aa, Homo sapiens
CASSLGVGTEGEKLFF

SEQ ID NO: 2433 - protein, 14 aa, Homo sapiens
CASSLLSRPDTQYF

SEQ ID NO: 2434 - protein, 14 aa, Homo sapiens
CASSLQGNTGELFF

SEQ ID NO: 2435 - protein, 14 aa, Homo sapiens
CASSLVGTSYEQYF

SEQ ID NO: 2436 - protein, 15 aa, Homo sapiens
CASSPDRSSYNEQFF

SEQ ID NO: 2437 - protein, 14 aa, Homo sapiens
CASSPGGMDTEAFF

SEQ ID NO: 2438 - protein, 12 aa, Homo sapiens
CASSPGGNEQFF

SEQ ID NO: 2439 - protein, 13 aa, Homo sapiens
CASSPGPNNEQFF

SEQ ID NO: 2440 - protein, 12 aa, Homo sapiens
CASSPGPYEQYF

SEQ ID NO: 2441 - protein, 16 aa, Homo sapiens
CASSPPGIAGVNEQFF

SEQ ID NO: 2442 - protein, 17 aa, Homo sapiens
CASSPPNREHGTGELFF

SEQ ID NO: 2443 - protein, 17 aa, Homo sapiens
CASSPPNREHGTGELFF

SEQ ID NO: 2444 - protein, 16 aa, Homo sapiens
CASSPPWRPQTDTQYF

SEQ ID NO: 2445 - protein, 15 aa, Homo sapiens
CASSPQDLLYYEQYF

SEQ ID NO: 2446 - protein, 13 aa, Homo sapiens
CASSPSLGEKLFF

SEQ ID NO: 2447 - protein, 13 aa, Homo sapiens
CASSQALSYEQYF

SEQ ID NO: 2448 - protein, 14 aa, Homo sapiens
CASSQDPAYYGYTF

SEQ ID NO: 2449 - protein, 16 aa, Homo sapiens
CASSQLDRTNTGELFF

SEQ ID NO: 2450 - protein, 14 aa, Homo sapiens
CASSQWVGGTEAFF

SEQ ID NO: 2451 - protein, 15 aa, Homo sapiens
CASSRSSSSTDTQYF

SEQ ID NO: 2452 - protein, 14 aa, Homo sapiens
CASSRTGGYTEAFF

SEQ ID NO: 2453 - protein, 14 aa, Homo sapiens
CASSSDGSGYGYTF

SEQ ID NO: 2454 - protein, 14 aa, Homo sapiens
CASSSGLATDTQYF

SEQ ID NO: 2455 - protein, 12 aa, Homo sapiens
CASSSLTYEQYF

SEQ ID NO: 2456 - protein, 16 aa, Homo sapiens
CASSSRRGLEDNEQFF

SEQ ID NO: 2457 - protein, 16 aa, Homo sapiens
CASSSRWDASGNTIYF

SEQ ID NO: 2458 - protein, 11 aa, Homo sapiens
CASSTAYEQYF

SEQ ID NO: 2459 - protein, 15 aa, Homo sapiens
CASSTLVGGAAEAFF

SEQ ID NO: 2460 - protein, 11 aa, Homo sapiens
CASSTYNEQFF

SEQ ID NO: 2461 - protein, 11 aa, Homo sapiens
CASSTYNEQFF

SEQ ID NO: 2462 - protein, 14 aa, Homo sapiens
CASSWGQVITEAFF

SEQ ID NO: 2463 - protein, 14 aa, Homo sapiens
CASSYGEENSPLHF

SEQ ID NO: 2464 - protein, 14 aa, Homo sapiens
CASSYGLGQETQYF

SEQ ID NO: 2465 - protein, 16 aa, Homo sapiens
CASSYGWAASGNTIYF

SEQ ID NO: 2466 - protein, 15 aa, Homo sapiens
CASSYLGATNEKLFF

SEQ ID NO: 2467 - protein, 12 aa, Homo sapiens
CASTDSPEKLFF

SEQ ID NO: 2468 - protein, 15 aa, Homo sapiens
CASTQGSSYNSPLHF

SEQ ID NO: 2469 - protein, 13 aa, Homo sapiens
CATEGQGLGEQFF

SEQ ID NO: 2470 - protein, 15 aa, Homo sapiens
CATGWGDSSTDTQYF

SEQ ID NO: 2471 - protein, 14 aa, Homo sapiens
CATSDANSNQPQHF

SEQ ID NO: 2472 - protein, 14 aa, Homo sapiens
CATSEGLALGEQFF

SEQ ID NO: 2473 - protein, 15 aa, Homo sapiens
CATSRDSIGGTEQFF

SEQ ID NO: 2474 - protein, 14 aa, Homo sapiens
CAVQGGSGTGELFF

SEQ ID NO: 2475 - protein, 15 aa, Homo sapiens
CSAFRGAGDTDTQYF

SEQ ID NO: 2476 - protein, 15 aa, Homo sapiens
CSAFVGGRDYNEQFF

SEQ ID NO: 2477 - protein, 14 aa, Homo sapiens
CSAPTETGAEKLFF

SEQ ID NO: 2478 - protein, 15 aa, Homo sapiens
CSARDFGSSSYEQYF

SEQ ID NO: 2479 - protein, 14 aa, Homo sapiens
CSAREDREYQPQHF

SEQ ID NO: 2480 - protein, 15 aa, Homo sapiens
CSARELLGDSYEQYF

SEQ ID NO: 2481 - protein, 13 aa, Homo sapiens
CSDATGESDTQYF

SEQ ID NO: 2482 - protein, 13 aa, Homo sapiens
CAAKMGVTGELFF

SEQ ID NO: 2483 - protein, 17 aa, Homo sapiens
CANTFDPPGQGNPEAFF

SEQ ID NO: 2484 - protein, 18 aa, Homo sapiens
CASIEMIGQGPNTGELFF

SEQ ID NO: 2485 - protein, 14 aa, Homo sapiens
CASNSGGPPIEQFF

SEQ ID NO: 2486 - protein, 12 aa, Homo sapiens
CASRGTGYEQYF

SEQ ID NO: 2487 - protein, 12 aa, Homo sapiens
CASRGTGYEQYF

SEQ ID NO: 2488 - protein, 14 aa, Homo sapiens
CASRKGQPPDTQYF

SEQ ID NO: 2489 - protein, 19 aa, Homo sapiens
CASRNTDPWGVRSTDTQYF

SEQ ID NO: 2490 - protein, 14 aa, Homo sapiens
CASRSSGRALEQYF

SEQ ID NO: 2491 - protein, 14 aa, Homo sapiens
CASSDPNRADTQYF

SEQ ID NO: 2492 - protein, 15 aa, Homo sapiens
CASSFGGRALNEQFF

SEQ ID NO: 2493 - protein, 16 aa, Homo sapiens
CASSFMSGSLGNEQFF

SEQ ID NO: 2494 - protein, 13 aa, Homo sapiens
CASSGLAGGEQFF

SEQ ID NO: 2495 - protein, 15 aa, Homo sapiens
CASSIMGQGGQPQHF

SEQ ID NO: 2496 - protein, 16 aa, Homo sapiens
CASSIVSSRYTDTQYF

SEQ ID NO: 2497 - protein, 14 aa, Homo sapiens
CASSKDSSSYEQYF

SEQ ID NO: 2498 - protein, 14 aa, Homo sapiens
CASSLAFGDNEQFF

SEQ ID NO: 2499 - protein, 15 aa, Homo sapiens
CASSLATGQVGEQYF

SEQ ID NO: 2500 - protein, 18 aa, Homo sapiens
CASSLAYRHRTAYYEQYF

SEQ ID NO: 2501 - protein, 17 aa, Homo sapiens
CASSLDGTFLRTDTQYF

SEQ ID NO: 2502 - protein, 13 aa, Homo sapiens
CASSLDVSYEQYF

SEQ ID NO: 2503 - protein, 16 aa, Homo sapiens
CASSLEGLSNTGELFF

SEQ ID NO: 2504 - protein, 16 aa, Homo sapiens
CASSLEYPGTGIEQYF

SEQ ID NO: 2505 - protein, 15 aa, Homo sapiens
CASSLGAGGIYEQYF

SEQ ID NO: 2506 - protein, 14 aa, Homo sapiens
CASSLGAVLYEQYF

SEQ ID NO: 2507 - protein, 14 aa, Homo sapiens
CASSLGGLIYEQYF

SEQ ID NO: 2508 - protein, 13 aa, Homo sapiens
CASSLGGQREAFF

SEQ ID NO: 2509 - protein, 13 aa, Homo sapiens
CASSLGQGYEQYF

SEQ ID NO: 2510 - protein, 15 aa, Homo sapiens
CASSLGWGAKNIQYF

SEQ ID NO: 2511 - protein, 15 aa, Homo sapiens
CASSLNSYSNQPQHF

SEQ ID NO: 2512 - protein, 14 aa, Homo sapiens
CASSLRGSNQPQHF

SEQ ID NO: 2513 - protein, 18 aa, Homo sapiens
CASSLSGLAGWSDNEQFF

SEQ ID NO: 2514 - protein, 13 aa, Homo sapiens
CASSLYSSYEQYF

SEQ ID NO: 2515 - protein, 15 aa, Homo sapiens
CASSPGEGRTDTQYF

SEQ ID NO: 2516 - protein, 11 aa, Homo sapiens
CASSPGPEAFF

SEQ ID NO: 2517 - protein, 14 aa, Homo sapiens
CASSPIDKPGELFF

SEQ ID NO: 2518 - protein, 15 aa, Homo sapiens
CASSPLARGNTEAFF

SEQ ID NO: 2519 - protein, 15 aa, Homo sapiens
CASSPMSTVFSYEQY

SEQ ID NO: 2520 - protein, 13 aa, Homo sapiens
CASSPPAGTEAFF

SEQ ID NO: 2521 - protein, 14 aa, Homo sapiens
CASSQAGESDTQYF

SEQ ID NO: 2522 - protein, 15 aa, Homo sapiens
CASSQDGTGSYEQYF

SEQ ID NO: 2523 - protein, 16 aa, Homo sapiens
CASSQGWQARGSPLHF

SEQ ID NO: 2524 - protein, 16 aa, Homo sapiens
CASSQLETTRKGKLFF

SEQ ID NO: 2525 - protein, 15 aa, Homo sapiens
CASSRAPEGNTEAFF

SEQ ID NO: 2526 - protein, 16 aa, Homo sapiens
CASSRNRDRENYGYTF

SEQ ID NO: 2527 - protein, 16 aa, Homo sapiens
CASSSHGTQGSYEQYF

SEQ ID NO: 2528 - protein, 17 aa, Homo sapiens
CASSSTDRGPRDQPQHF

SEQ ID NO: 2529 - protein, 17 aa, Homo sapiens
CASSVDGSQYHKNIQYF

SEQ ID NO: 2530 - protein, 13 aa, Homo sapiens
CASSVEAKTEAFF

SEQ ID NO: 2531 - protein, 16 aa, Homo sapiens
CASSVGGRTIEDEQYF

SEQ ID NO: 2532 - protein, 14 aa, Homo sapiens
CASSVGGSTGELFF

SEQ ID NO: 2533 - protein, 17 aa, Homo sapiens
CASSVPDGTGGDNGYTF

SEQ ID NO: 2534 - protein, 15 aa, Homo sapiens
CASSWSVLSTDTQYF

SEQ ID NO: 2535 - protein, 15 aa, Homo sapiens
CASSYFDSVNTEAFF

SEQ ID NO: 2536 - protein, 13 aa, Homo sapiens
CASTYSDTGELFF

SEQ ID NO: 2537 - protein, 13 aa, Homo sapiens
CASTYSDTGELFF

SEQ ID NO: 2538 - protein, 13 aa, Homo sapiens
CASTYSDTGELFF

SEQ ID NO: 2539 - protein, 13 aa, Homo sapiens
CASTYSDTGELFF

SEQ ID NO: 2540 - protein, 16 aa, Homo sapiens
CATSDPMTGGTNEQYF

SEQ ID NO: 2541 - protein, 16 aa, Homo sapiens
CAWQTRARGRNSPLHF

SEQ ID NO: 2542 - protein, 16 aa, Homo sapiens
CAWRPPGQGPGNTIYF

SEQ ID NO: 2543 - protein, 17 aa, Homo sapiens
CSADSLTGQGAGDTQYF

SEQ ID NO: 2544 - protein, 14 aa, Homo sapiens
CSAGPGDLNTEAFF

SEQ ID NO: 2545 - protein, 13 aa, Homo sapiens
CSAGTSDLNEQFF

SEQ ID NO: 2546 - protein, 15 aa, Homo sapiens
CSARDGGRDTGELFF

SEQ ID NO: 2547 - protein, 15 aa, Homo sapiens
CSARDVGAGTGELFF

SEQ ID NO: 2548 - protein, 14 aa, Homo sapiens
CSAREGHESSPLHF

SEQ ID NO: 2549 - protein, 14 aa, Homo sapiens
CSAREGLGHLEQYF

SEQ ID NO: 2550 - protein, 14 aa, Homo sapiens
CSAREGPSSYEQYF

SEQ ID NO: 2551 - protein, 13 aa, Homo sapiens
CSARGFRAGEQFF

SEQ ID NO: 2552 - protein, 15 aa, Homo sapiens
CSARGFSGPNYEQYF

SEQ ID NO: 2553 - protein, 14 aa, Homo sapiens
CSARSPSTDYEQYF

SEQ ID NO: 2554 - protein, 15 aa, Homo sapiens
CSASNIAGGRETQYF

SEQ ID NO: 2555 - protein, 15 aa, Homo sapiens
CSASNIAGGRETQYF

SEQ ID NO: 2556 - protein, 12 aa, Homo sapiens
CSATSTVYEQYF

SEQ ID NO: 2557 - protein, 15 aa, Homo sapiens
CSAYQEDVSGNTIYF

SEQ ID NO: 2558 - protein, 15 aa, Homo sapiens
CSVEDELAGGHEQFF

SEQ ID NO: 2559 - protein, 16 aa, Homo sapiens
CSVEVPLVLDYNEQFF

SEQ ID NO: 2560 - protein, 12 aa, Homo sapiens
CSVEVRLNEQFF

SEQ ID NO: 2561 - protein, 15 aa, Homo sapiens
CAILNSPGQYRTQYF

SEQ ID NO: 2562 - protein, 15 aa, Homo sapiens
CAISEPDRGVYEQYF

SEQ ID NO: 2563 - protein, 16 aa, Homo sapiens
CAISERGGTGAYEQYF

SEQ ID NO: 2564 - protein, 15 aa, Homo sapiens
CASAFFGEAGYGYTF

SEQ ID NO: 2565 - protein, 11 aa, Homo sapiens
CASMDGSEQFF

SEQ ID NO: 2566 - protein, 14 aa, Homo sapiens
CASNGEREGYEQYF

SEQ ID NO: 2567 - protein, 13 aa, Homo sapiens
CASRIGTYTEAFF

SEQ ID NO: 2568 - protein, 13 aa, Homo sapiens
CASRPMGTDTQYF

SEQ ID NO: 2569 - protein, 13 aa, Homo sapiens
CASRSLAGGEQFF

SEQ ID NO: 2570 - protein, 13 aa, Homo sapiens
CASRTSGTDTQYF

SEQ ID NO: 2571 - protein, 14 aa, Homo sapiens
CASSEEGAGYEQYF

SEQ ID NO: 2572 - protein, 15 aa, Homo sapiens
CASSEGHPSQYEQYF

SEQ ID NO: 2573 - protein, 18 aa, Homo sapiens
CASSENKIGVAVSYEQYF

SEQ ID NO: 2574 - protein, 12 aa, Homo sapiens
CASSEYYYEQYF

SEQ ID NO: 2575 - protein, 16 aa, Homo sapiens
CASSFDRDRGPQPQHF

SEQ ID NO: 2576 - protein, 14 aa, Homo sapiens
CASSFGGEGETQYF

SEQ ID NO: 2577 - protein, 14 aa, Homo sapiens
CASSFSGTNEKLFF

SEQ ID NO: 2578 - protein, 14 aa, Homo sapiens
CASSFSTSGNTIYF

SEQ ID NO: 2579 - protein, 16 aa, Homo sapiens
CASSFTTSGATDTQYF

SEQ ID NO: 2580 - protein, 13 aa, Homo sapiens
CASSGHFQETQYF

SEQ ID NO: 2581 - protein, 17 aa, Homo sapiens
CASSGLAGGSGYNEQFF

SEQ ID NO: 2582 - protein, 15 aa, Homo sapiens
CASSIELLNREKLFF

SEQ ID NO: 2583 - protein, 11 aa, Homo sapiens
CASSILTEAFF

SEQ ID NO: 2584 - protein, 13 aa, Homo sapiens
CASSIPWTGELFF

SEQ ID NO: 2585 - protein, 13 aa, Homo sapiens
CASSITFSYEQYF

SEQ ID NO: 2586 - protein, 14 aa, Homo sapiens
CASSKGYGNQPQHF

SEQ ID NO: 2587 - protein, 15 aa, Homo sapiens
CASSLAGDGYNEQFF

SEQ ID NO: 2588 - protein, 16 aa, Homo sapiens
CASSLDSGRAQDTQYF

SEQ ID NO: 2589 - protein, 13 aa, Homo sapiens
CASSLDSSYEQYF

SEQ ID NO: 2590 - protein, 16 aa, Homo sapiens
CASSLGGRASSYEQYF

SEQ ID NO: 2591 - protein, 16 aa, Homo sapiens
CASSLGSGGPFDEQFF

SEQ ID NO: 2592 - protein, 14 aa, Homo sapiens
CASSLGYGEETQYF

SEQ ID NO: 2593 - protein, 15 aa, Homo sapiens
CASSLGYGEGETQYF

SEQ ID NO: 2594 - protein, 15 aa, Homo sapiens
CASSLGYGSTDTQYF

SEQ ID NO: 2595 - protein, 17 aa, Homo sapiens
CASSLIPEGVGTDTQYF

SEQ ID NO: 2596 - protein, 13 aa, Homo sapiens
CASSLRGNTEAFF

SEQ ID NO: 2597 - protein, 15 aa, Homo sapiens
CASSLTSGSLNEQYF

SEQ ID NO: 2598 - protein, 16 aa, Homo sapiens
CASSLVPTGEDYGYTF

SEQ ID NO: 2599 - protein, 13 aa, Homo sapiens
CASSMGGPDTQYF

SEQ ID NO: 2600 - protein, 15 aa, Homo sapiens
CASSNGQVWNTEAFF

SEQ ID NO: 2601 - protein, 16 aa, Homo sapiens
CASSPAGRTYSYEQYF

SEQ ID NO: 2602 - protein, 13 aa, Homo sapiens
CASSPGRTYEQYF

SEQ ID NO: 2603 - protein, 12 aa, Homo sapiens
CASSPGSTEAFF

SEQ ID NO: 2604 - protein, 20 aa, Homo sapiens
CASSPHSPGLAGVSQETQYF

SEQ ID NO: 2605 - protein, 16 aa, Homo sapiens
CASSPQWGTGEYEQFF

SEQ ID NO: 2606 - protein, 15 aa, Homo sapiens
CASSPRTAMNTEAFF

SEQ ID NO: 2607 - protein, 16 aa, Homo sapiens
CASSQDWPGSSYEQYF

SEQ ID NO: 2608 - protein, 14 aa, Homo sapiens
CASSQEGFNQPQHF

SEQ ID NO: 2609 - protein, 15 aa, Homo sapiens
CASSQELSPPYEQYF

SEQ ID NO: 2610 - protein, 15 aa, Homo sapiens
CASSQGAEYQETQYF

SEQ ID NO: 2611 - protein, 12 aa, Homo sapiens
CASSQGGREQYF

SEQ ID NO: 2612 - protein, 13 aa, Homo sapiens
CASSQLGDFGYTF

SEQ ID NO: 2613 - protein, 15 aa, Homo sapiens
CASSQLQQGLTEAFF

SEQ ID NO: 2614 - protein, 13 aa, Homo sapiens
CASSQRRTDTQYF

SEQ ID NO: 2615 - protein, 16 aa, Homo sapiens
CASSRQGAAPANVLTF

SEQ ID NO: 2616 - protein, 14 aa, Homo sapiens
CASSRSGASYEQYF

SEQ ID NO: 2617 - protein, 11 aa, Homo sapiens
CASSSGDEQFF

SEQ ID NO: 2618 - protein, 17 aa, Homo sapiens
CASSSKGPQASNEKLFF

SEQ ID NO: 2619 - protein, 14 aa, Homo sapiens
CASSSLQGDDEQYF

SEQ ID NO: 2620 - protein, 20 aa, Homo sapiens
CASSSPFSGLAGTYSYEQYF

SEQ ID NO: 2621 - protein, 18 aa, Homo sapiens
CASSSSDRAVIWTGELFF

SEQ ID NO: 2622 - protein, 12 aa, Homo sapiens
CASSSSGTEQYF

SEQ ID NO: 2623 - protein, 14 aa, Homo sapiens
CASSVDPARDIQYF

SEQ ID NO: 2624 - protein, 16 aa, Homo sapiens
CASSVSGTSGRNEQFF

SEQ ID NO: 2625 - protein, 14 aa, Homo sapiens
CASSYSSGWQPMDF

SEQ ID NO: 2626 - protein, 19 aa, Homo sapiens
CASTAIGGTGQYSNQPQHF

SEQ ID NO: 2627 - protein, 14 aa, Homo sapiens
CASTRGGGGSEAFF

SEQ ID NO: 2628 - protein, 16 aa, Homo sapiens
CASTSRTVSSYNEQFF

SEQ ID NO: 2629 - protein, 16 aa, Homo sapiens
CATSDYRDSTYNEQFF

SEQ ID NO: 2630 - protein, 16 aa, Homo sapiens
CATSFSRDRGNQPQHF

SEQ ID NO: 2631 - protein, 15 aa, Homo sapiens
CATSRDRGGTGELFF

SEQ ID NO: 2632 - protein, 11 aa, Homo sapiens
CAVAHTDTQYF

SEQ ID NO: 2633 - protein, 12 aa, Homo sapiens
CAWSVGNTEAFF

SEQ ID NO: 2634 - protein, 15 aa, Homo sapiens
CDLNETFRRPYEQYF

SEQ ID NO: 2635 - protein, 12 aa, Homo sapiens
CSADHRGDEQFF

SEQ ID NO: 2636 - protein, 10 aa, Homo sapiens
CSAHEETQYF

SEQ ID NO: 2637 - protein, 12 aa, Homo sapiens
CSANRERVEQYF

SEQ ID NO: 2638 - protein, 13 aa, Homo sapiens
CSAPSGQGYEQYF

SEQ ID NO: 2639 - protein, 15 aa, Homo sapiens
CSARDSGSSWDEQFF

SEQ ID NO: 2640 - protein, 15 aa, Homo sapiens
CSGDTWEAGQETQYF

SEQ ID NO: 2641 - protein, 13 aa, Homo sapiens
CSSIGELLDGYTF

SEQ ID NO: 2642 - protein, 13 aa, Homo sapiens
CSSIGELLDGYTF

SEQ ID NO: 2643 - protein, 13 aa, Homo sapiens
CSSIGELLDGYTF

SEQ ID NO: 2644 - protein, 13 aa, Homo sapiens
CSSIGELLDGYTF

SEQ ID NO: 2645 - protein, 13 aa, Homo sapiens
CSVGAPGSDTQYF

SEQ ID NO: 2646 - protein, 14 aa, Homo sapiens
CASRNSADSYEQYF

SEQ ID NO: 2647 - protein, 14 aa, Homo sapiens
CASRNSADSYEQYF

SEQ ID NO: 2648 - protein, 12 aa, Homo sapiens
CASRRRMTEAFF

SEQ ID NO: 2649 - protein, 16 aa, Homo sapiens
CASSEETGGTSTEAFF

SEQ ID NO: 2650 - protein, 16 aa, Homo sapiens
CASSERQGNIYSEQYF

SEQ ID NO: 2651 - protein, 16 aa, Homo sapiens
CASSESGGADYNEQFF

SEQ ID NO: 2652 - protein, 14 aa, Homo sapiens
CASSFGFSGNTIYF

SEQ ID NO: 2653 - protein, 14 aa, Homo sapiens
CASSFGFSGNTIYF

SEQ ID NO: 2654 - protein, 14 aa, Homo sapiens
CASSFGFSGNTIYF

SEQ ID NO: 2655 - protein, 13 aa, Homo sapiens
CASSFLGYTEAFF

SEQ ID NO: 2656 - protein, 14 aa, Homo sapiens
CASSFLSGTDTQYF

SEQ ID NO: 2657 - protein, 16 aa, Homo sapiens
CASSFRQGASTGELFF

SEQ ID NO: 2658 - protein, 15 aa, Homo sapiens
CASSIQLVPVETQYF

SEQ ID NO: 2659 - protein, 12 aa, Homo sapiens
CASSLDVGEQFF

SEQ ID NO: 2660 - protein, 17 aa, Homo sapiens
CASSLEGGPVVGSPLHF

SEQ ID NO: 2661 - protein, 16 aa, Homo sapiens
CASSLELAGGRDTQYF

SEQ ID NO: 2662 - protein, 16 aa, Homo sapiens
CASSLEWTGGVYEQFF

SEQ ID NO: 2663 - protein, 15 aa, Homo sapiens
CASSLGRGLNQPQHF

SEQ ID NO: 2664 - protein, 18 aa, Homo sapiens
CASSLSFGSSGIRREQFF

SEQ ID NO: 2665 - protein, 16 aa, Homo sapiens
CASSLWASGSTDTQYF

SEQ ID NO: 2666 - protein, 13 aa, Homo sapiens
CASSPDRGNEQFF

SEQ ID NO: 2667 - protein, 15 aa, Homo sapiens
CASSPSGSPANEQFF

SEQ ID NO: 2668 - protein, 15 aa, Homo sapiens
CASSPTFSGRNEQFF

SEQ ID NO: 2669 - protein, 16 aa, Homo sapiens
CASSQVLSRGYGEQFF

SEQ ID NO: 2670 - protein, 17 aa, Homo sapiens
CASSRFWGGASTDTQYF

SEQ ID NO: 2671 - protein, 15 aa, Homo sapiens
CASSSGQGARETQYF

SEQ ID NO: 2672 - protein, 15 aa, Homo sapiens
CASSSNVGEGNEQFF

SEQ ID NO: 2673 - protein, 15 aa, Homo sapiens
CASSSPSGGTYEQYF

SEQ ID NO: 2674 - protein, 13 aa, Homo sapiens
CASSTGLREKLFF

SEQ ID NO: 2675 - protein, 13 aa, Homo sapiens
CASSTGLREKLFF

SEQ ID NO: 2676 - protein, 16 aa, Homo sapiens
CASSWGGDSSTDTQYF

SEQ ID NO: 2677 - protein, 16 aa, Homo sapiens
CASSWGGDSSTDTQYF

SEQ ID NO: 2678 - protein, 16 aa, Homo sapiens
CASSWGGDSSTDTQYF

SEQ ID NO: 2679 - protein, 16 aa, Homo sapiens
CASSWGGDSSTDTQYF

SEQ ID NO: 2680 - protein, 16 aa, Homo sapiens
CASSWGGDSSTDTQYF

SEQ ID NO: 2681 - protein, 16 aa, Homo sapiens
CASSWGGDSSTDTQYF

SEQ ID NO: 2682 - protein, 16 aa, Homo sapiens
CASSWGGDSSTDTQYF

SEQ ID NO: 2683 - protein, 16 aa, Homo sapiens
CASSWGGDSSTDTQYF

SEQ ID NO: 2684 - protein, 16 aa, Homo sapiens
CASSWGGDSSTDTQYF

SEQ ID NO: 2685 - protein, 16 aa, Homo sapiens
CASSWGGDSSTDTQYF

SEQ ID NO: 2686 - protein, 16 aa, Homo sapiens
CASSWGGDSSTDTQYF

SEQ ID NO: 2687 - protein, 16 aa, Homo sapiens
CASSWGGDSSTDTQYF

SEQ ID NO: 2688 - protein, 16 aa, Homo sapiens
CASSWGGDSSTDTQYF

SEQ ID NO: 2689 - protein, 16 aa, Homo sapiens
CASSWGGDSSTDTQYF

SEQ ID NO: 2690 - protein, 16 aa, Homo sapiens
CASSWGGDSSTDTQYF

SEQ ID NO: 2691 - protein, 16 aa, Homo sapiens
CASSWGGDSSTDTQYF

SEQ ID NO: 2692 - protein, 16 aa, Homo sapiens
CASSWGGDSSTDTQYF

SEQ ID NO: 2693 - protein, 16 aa, Homo sapiens
CASSWGGDSSTDTQYF

SEQ ID NO: 2694 - protein, 16 aa, Homo sapiens
CASSWGGDSSTDTQYF

SEQ ID NO: 2695 - protein, 16 aa, Homo sapiens
CASSWGGDSSTDTQYF

SEQ ID NO: 2696 - protein, 16 aa, Homo sapiens
CASSWGGDSSTDTQYF

SEQ ID NO: 2697 - protein, 16 aa, Homo sapiens
CASSWGGDSSTDTQYF

SEQ ID NO: 2698 - protein, 16 aa, Homo sapiens
CASSWGGDSSTDTQYF

SEQ ID NO: 2699 - protein, 14 aa, Homo sapiens
CASSYTDSNTEAFF

SEQ ID NO: 2700 - protein, 16 aa, Homo sapiens
CASSYTQGRTNEKLFF

SEQ ID NO: 2701 - protein, 13 aa, Homo sapiens
CAWSTGNEETQYF

SEQ ID NO: 2702 - protein, 14 aa, Homo sapiens
CAWTPGRGREKLFF

SEQ ID NO: 2703 - protein, 13 aa, Homo sapiens
CSGRKADSYEQYF

SEQ ID NO: 2704 - protein, 17 aa, Homo sapiens
CSVNTGTGHPSGHGYTF

SEQ ID NO: 2705 - protein, 17 aa, Homo sapiens
CAISETPSGNPTYEQYF

SEQ ID NO: 2706 - protein, 13 aa, Homo sapiens
CASKSSGGDTQYF

SEQ ID NO: 2707 - protein, 14 aa, Homo sapiens
CASPTVGLLETQYF

SEQ ID NO: 2708 - protein, 14 aa, Homo sapiens
CASPTVGLLETQYF

SEQ ID NO: 2709 - protein, 14 aa, Homo sapiens
CASPTVGLLETQYF

SEQ ID NO: 2710 - protein, 14 aa, Homo sapiens
CASPTVGLLETQYF

SEQ ID NO: 2711 - protein, 14 aa, Homo sapiens
CASPTVRLLETQYF

SEQ ID NO: 2712 - protein, 14 aa, Homo sapiens
CASRGQQNFYGYTF

SEQ ID NO: 2713 - protein, 14 aa, Homo sapiens
CASRSWGYPETQYF

SEQ ID NO: 2714 - protein, 14 aa, Homo sapiens
CASRSWGYPETQYF

SEQ ID NO: 2715 - protein, 15 aa, Homo sapiens
CASSADSGVTYEQYF

SEQ ID NO: 2716 - protein, 15 aa, Homo sapiens
CASSAGQVFPGELFF

SEQ ID NO: 2717 - protein, 15 aa, Homo sapiens
CASSDGGGAQETQYF

SEQ ID NO: 2718 - protein, 15 aa, Homo sapiens
CASSDGGGAQETQYF

SEQ ID NO: 2719 - protein, 15 aa, Homo sapiens
CASSDGGGAQETQYF

SEQ ID NO: 2720 - protein, 15 aa, Homo sapiens
CASSDGGGAQETQYF

SEQ ID NO: 2721 - protein, 15 aa, Homo sapiens
CASSDGGGASETQYF

SEQ ID NO: 2722 - protein, 15 aa, Homo sapiens
CASSDGGGASETQYF

SEQ ID NO: 2723 - protein, 15 aa, Homo sapiens
CASSEAGTGRETQYF

SEQ ID NO: 2724 - protein, 15 aa, Homo sapiens
CASSEGGGAQETQYF

SEQ ID NO: 2725 - protein, 15 aa, Homo sapiens
CASSEGGGGQETQYF

SEQ ID NO: 2726 - protein, 15 aa, Homo sapiens
CASSEGGGGQETQYF

SEQ ID NO: 2727 - protein, 15 aa, Homo sapiens
CASSEGGGGQETQYF

SEQ ID NO: 2728 - protein, 15 aa, Homo sapiens
CASSEGGGGQETQYF

SEQ ID NO: 2729 - protein, 15 aa, Homo sapiens
CASSEGGGGQETQYF

SEQ ID NO: 2730 - protein, 15 aa, Homo sapiens
CASSEGGGGQETQYF

SEQ ID NO: 2731 - protein, 15 aa, Homo sapiens
CASSEGGGGQETQYF

SEQ ID NO: 2732 - protein, 15 aa, Homo sapiens
CASSEGGGGQETQYF

SEQ ID NO: 2733 - protein, 15 aa, Homo sapiens
CASSEGGGLAETQYF

SEQ ID NO: 2734 - protein, 15 aa, Homo sapiens
CASSEGGGLAETQYF

SEQ ID NO: 2735 - protein, 14 aa, Homo sapiens
CASSFNRVRDTQYF

SEQ ID NO: 2736 - protein, 14 aa, Homo sapiens
CASSFSTDGTEAFF

SEQ ID NO: 2737 - protein, 14 aa, Homo sapiens
CASSGRPGGEKLFF

SEQ ID NO: 2738 - protein, 15 aa, Homo sapiens
CASSHLQGYGNTIYF

SEQ ID NO: 2739 - protein, 16 aa, Homo sapiens
CASSIGHSAGSGELFF

SEQ ID NO: 2740 - protein, 14 aa, Homo sapiens
CASSLAGGLDTQYF

SEQ ID NO: 2741 - protein, 16 aa, Homo sapiens
CASSLAVQLAKNIQYF

SEQ ID NO: 2742 - protein, 16 aa, Homo sapiens
CASSLFWETAQETQYF

SEQ ID NO: 2743 - protein, 16 aa, Homo sapiens
CASSLFWETAQETQYF

SEQ ID NO: 2744 - protein, 16 aa, Homo sapiens
CASSLFWETAQETQYF

SEQ ID NO: 2745 - protein, 16 aa, Homo sapiens
CASSLGARGWGNEQFF

SEQ ID NO: 2746 - protein, 14 aa, Homo sapiens
CASSLLTGRTEAFF

SEQ ID NO: 2747 - protein, 14 aa, Homo sapiens
CASSLSAGSAEQYF

SEQ ID NO: 2748 - protein, 16 aa, Homo sapiens
CASSPFRGEIVETQYF

SEQ ID NO: 2749 - protein, 16 aa, Homo sapiens
CASSPFRGEIVETQYF

SEQ ID NO: 2750 - protein, 16 aa, Homo sapiens
CASSPFRGEIVETQYF

SEQ ID NO: 2751 - protein, 16 aa, Homo sapiens
CASSPFRGEIVETQYF

SEQ ID NO: 2752 - protein, 16 aa, Homo sapiens
CASSPFRGEIVETQYF

SEQ ID NO: 2753 - protein, 16 aa, Homo sapiens
CASSPFRGEIVETQYF

SEQ ID NO: 2754 - protein, 16 aa, Homo sapiens
CASSPFRGEIVETQYF

SEQ ID NO: 2755 - protein, 16 aa, Homo sapiens
CASSPFRGEIVETQYF

SEQ ID NO: 2756 - protein, 15 aa, Homo sapiens
CASSQEANRGEVQYF

SEQ ID NO: 2757 - protein, 17 aa, Homo sapiens
CASSQGQLAGLNYEQYF

SEQ ID NO: 2758 - protein, 18 aa, Homo sapiens
CASSQGTSGPGATGELFF

SEQ ID NO: 2759 - protein, 14 aa, Homo sapiens
CASSRQLLNEKLFF

SEQ ID NO: 2760 - protein, 15 aa, Homo sapiens
CASSSQGTNTGELFF

SEQ ID NO: 2761 - protein, 15 aa, Homo sapiens
CASSSQGTNTGELFF

SEQ ID NO: 2762 - protein, 15 aa, Homo sapiens
CASSSRAGAGGEQFF

SEQ ID NO: 2763 - protein, 15 aa, Homo sapiens
CASSSRAGAGGEQFF

SEQ ID NO: 2764 - protein, 15 aa, Homo sapiens
CASSSRAGAGGEQFF

SEQ ID NO: 2765 - protein, 13 aa, Homo sapiens
CASSWRGTGELFF

SEQ ID NO: 2766 - protein, 14 aa, Homo sapiens
CASSYSGTTDTQYF

SEQ ID NO: 2767 - protein, 16 aa, Homo sapiens
CASTPRPAGEGEKLFF

SEQ ID NO: 2768 - protein, 11 aa, Homo sapiens
CAWSAATEAFF

SEQ ID NO: 2769 - protein, 16 aa, Homo sapiens
CSARPGQGGGYYEQYF

SEQ ID NO: 2770 - protein, 11 aa, Homo sapiens
CSVESANGYTF

SEQ ID NO: 2771 - protein, 11 aa, Homo sapiens
CSVESYNEQFF

SEQ ID NO: 2772 - protein, 15 aa, Homo sapiens
CASGSGQGRDNEQFF

SEQ ID NO: 2773 - protein, 15 aa, Homo sapiens
CASREDSWSFGELFF

SEQ ID NO: 2774 - protein, 13 aa, Homo sapiens
CASRPGTSKEQYF

SEQ ID NO: 2775 - protein, 16 aa, Homo sapiens
CASSEAGQGVRETQYF

SEQ ID NO: 2776 - protein, 15 aa, Homo sapiens
CASSEFGGSNQPQHF

SEQ ID NO: 2777 - protein, 14 aa, Homo sapiens
CASSEWSLRDEQFF

SEQ ID NO: 2778 - protein, 12 aa, Homo sapiens
CASSFREYEQYF

SEQ ID NO: 2779 - protein, 18 aa, Homo sapiens
CASSHLYAAGEGKNIQYF

SEQ ID NO: 2780 - protein, 14 aa, Homo sapiens
CASSHRDRNYEQYF

SEQ ID NO: 2781 - protein, 13 aa, Homo sapiens
CASSHSNTGELFF

SEQ ID NO: 2782 - protein, 16 aa, Homo sapiens
CASSIVAGASNQPQHF

SEQ ID NO: 2783 - protein, 18 aa, Homo sapiens
CASSKAGDTFRGQETQYF

SEQ ID NO: 2784 - protein, 18 aa, Homo sapiens
CASSLDQGGGGGSYEQYF

SEQ ID NO: 2785 - protein, 18 aa, Homo sapiens
CASSLDQGGGGGSYEQYF

SEQ ID NO: 2786 - protein, 18 aa, Homo sapiens
CASSLDQGGGGGSYEQYF

SEQ ID NO: 2787 - protein, 18 aa, Homo sapiens
CASSLDQGGGGGSYEQYF

SEQ ID NO: 2788 - protein, 13 aa, Homo sapiens
CASSLFTGREPFF

SEQ ID NO: 2789 - protein, 13 aa, Homo sapiens
CASSLGSTDTQYF

SEQ ID NO: 2790 - protein, 15 aa, Homo sapiens
CASSLVGASENIQYF

SEQ ID NO: 2791 - protein, 15 aa, Homo sapiens
CASSLVGASENIQYF

SEQ ID NO: 2792 - protein, 15 aa, Homo sapiens
CASSMGDREDYEQYF

SEQ ID NO: 2793 - protein, 15 aa, Homo sapiens
CASSMWVANTGELFF

SEQ ID NO: 2794 - protein, 15 aa, Homo sapiens
CASSNAAGPQETQYF

SEQ ID NO: 2795 - protein, 15 aa, Homo sapiens
CASSNAAGPQETQYF

SEQ ID NO: 2796 - protein, 15 aa, Homo sapiens
CASSNAAGPQETQYF

SEQ ID NO: 2797 - protein, 15 aa, Homo sapiens
CASSNAAGPQETQYF

SEQ ID NO: 2798 - protein, 14 aa, Homo sapiens
CASSPDREPMKQYF

SEQ ID NO: 2799 - protein, 14 aa, Homo sapiens
CASSPDREPMKQYF

SEQ ID NO: 2800 - protein, 14 aa, Homo sapiens
CASSPDREPMKQYF

SEQ ID NO: 2801 - protein, 14 aa, Homo sapiens
CASSPDREPMKQYF

SEQ ID NO: 2802 - protein, 13 aa, Homo sapiens
CASSPDRGNIQYF

SEQ ID NO: 2803 - protein, 14 aa, Homo sapiens
CASSPGQGYYGYTF

SEQ ID NO: 2804 - protein, 15 aa, Homo sapiens
CASSPHRGGNYGYTF

SEQ ID NO: 2805 - protein, 13 aa, Homo sapiens
CASSQDRSNEQFF

SEQ ID NO: 2806 - protein, 11 aa, Homo sapiens
CASSQGYEQYF

SEQ ID NO: 2807 - protein, 20 aa, Homo sapiens
CASSQVGREVSGRALDEQFF

SEQ ID NO: 2808 - protein, 20 aa, Homo sapiens
CASSQVGREVSGRALDEQFF

SEQ ID NO: 2809 - protein, 20 aa, Homo sapiens
CASSQVGREVSGRALDEQFF

SEQ ID NO: 2810 - protein, 20 aa, Homo sapiens
CASSQVGREVSGRALDEQFF

SEQ ID NO: 2811 - protein, 15 aa, Homo sapiens
CASSQVQGGGTEAFF

SEQ ID NO: 2812 - protein, 14 aa, Homo sapiens
CASSRLANYNEQFF

SEQ ID NO: 2813 - protein, 15 aa, Homo sapiens
CASSSAGTPNYGYTF

SEQ ID NO: 2814 - protein, 17 aa, Homo sapiens
CASSSDLRWEGDTEAFF

SEQ ID NO: 2815 - protein, 14 aa, Homo sapiens
CASSSLTGNQPQHF

SEQ ID NO: 2816 - protein, 15 aa, Homo sapiens
CASSSPGTGEYEQYF

SEQ ID NO: 2817 - protein, 15 aa, Homo sapiens
CASSSYGTGGDEQFF

SEQ ID NO: 2818 - protein, 15 aa, Homo sapiens
CASSSYGTGGDEQFF

SEQ ID NO: 2819 - protein, 16 aa, Homo sapiens
CASSTGATGTNEKLFF

SEQ ID NO: 2820 - protein, 14 aa, Homo sapiens
CASSVVPNTDTQYF

SEQ ID NO: 2821 - protein, 18 aa, Homo sapiens
CASSWGWESGRAFDEQFF

SEQ ID NO: 2822 - protein, 14 aa, Homo sapiens
CASSWTGYSYEQYF

SEQ ID NO: 2823 - protein, 11 aa, Homo sapiens
CASSYGETAFF

SEQ ID NO: 2824 - protein, 11 aa, Homo sapiens
CASTAGDTIYF

SEQ ID NO: 2825 - protein, 11 aa, Homo sapiens
CASTAGDTIYF

SEQ ID NO: 2826 - protein, 17 aa, Homo sapiens
CATKQGARTSDTGELFF

SEQ ID NO: 2827 - protein, 14 aa, Homo sapiens
CATQVGGGSYEQYF

SEQ ID NO: 2828 - protein, 15 aa, Homo sapiens
CATSRGLAGAYEQYF

SEQ ID NO: 2829 - protein, 12 aa, Homo sapiens
CATVLGNTEAFF

SEQ ID NO: 2830 - protein, 14 aa, Homo sapiens
CAWSRGAGSNEAFF

SEQ ID NO: 2831 - protein, 13 aa, Homo sapiens
CAWSVFGGTEAFF

SEQ ID NO: 2832 - protein, 13 aa, Homo sapiens
CSAGTSSTGELFF

SEQ ID NO: 2833 - protein, 14 aa, Homo sapiens
CSARGAGRGHEQFF

SEQ ID NO: 2834 - protein, 14 aa, Homo sapiens
CSARGAGRGHEQFF

SEQ ID NO: 2835 - protein, 14 aa, Homo sapiens
CSARGAGRGHEQFF

SEQ ID NO: 2836 - protein, 14 aa, Homo sapiens
CSARGAGRGHEQFF

SEQ ID NO: 2837 - protein, 14 aa, Homo sapiens
CSARGPLRFYEQFF

SEQ ID NO: 2838 - protein, 15 aa, Homo sapiens
CAISESGGGSETQYF

SEQ ID NO: 2839 - protein, 19 aa, Homo sapiens
CASGLSRTSGTMSYNEQFF

SEQ ID NO: 2840 - protein, 17 aa, Homo sapiens
CASGNPKGQGDTGELFF

SEQ ID NO: 2841 - protein, 17 aa, Homo sapiens
CASKTVNRGFGTDTQYF

SEQ ID NO: 2842 - protein, 16 aa, Homo sapiens
CASQNLAGPQYNEQFF

SEQ ID NO: 2843 - protein, 12 aa, Homo sapiens
CASRGLYNEQFF

SEQ ID NO: 2844 - protein, 12 aa, Homo sapiens
CASRPGTDTQYF

SEQ ID NO: 2845 - protein, 15 aa, Homo sapiens
CASSADWDREAEAFF

SEQ ID NO: 2846 - protein, 13 aa, Homo sapiens
CASSAGDPDTQYF

SEQ ID NO: 2847 - protein, 14 aa, Homo sapiens
CASSAGGTNYGYTF

SEQ ID NO: 2848 - protein, 14 aa, Homo sapiens
CASSAGGTNYGYTF

SEQ ID NO: 2849 - protein, 14 aa, Homo sapiens
CASSAGGTNYGYTF

SEQ ID NO: 2850 - protein, 15 aa, Homo sapiens
CASSAGTGGNTEAFF

SEQ ID NO: 2851 - protein, 15 aa, Homo sapiens
CASSASSGTTYEQYF

SEQ ID NO: 2852 - protein, 14 aa, Homo sapiens
CASSEWQGNSPLHF

SEQ ID NO: 2853 - protein, 13 aa, Homo sapiens
CASSFAEAYEQYF

SEQ ID NO: 2854 - protein, 14 aa, Homo sapiens
CASSFETGRYEQYF

SEQ ID NO: 2855 - protein, 14 aa, Homo sapiens
CASSFGGPNTEAFF

SEQ ID NO: 2856 - protein, 15 aa, Homo sapiens
CASSFGLAKYNEQFF

SEQ ID NO: 2857 - protein, 13 aa, Homo sapiens
CASSFSVAYEQYF

SEQ ID NO: 2858 - protein, 15 aa, Homo sapiens
CASSFYSTNTGELFF

SEQ ID NO: 2859 - protein, 16 aa, Homo sapiens
CASSHERERNTGELFF

SEQ ID NO: 2860 - protein, 13 aa, Homo sapiens
CASSHRAADTQYF

SEQ ID NO: 2861 - protein, 14 aa, Homo sapiens
CASSLAGSNTEAFF

SEQ ID NO: 2862 - protein, 14 aa, Homo sapiens
CASSLELAGDEQYF

SEQ ID NO: 2863 - protein, 15 aa, Homo sapiens
CASSLEQGGNEKLFF

SEQ ID NO: 2864 - protein, 15 aa, Homo sapiens
CASSLESVNQETQYF

SEQ ID NO: 2865 - protein, 15 aa, Homo sapiens
CASSLETLNTGELFF

SEQ ID NO: 2866 - protein, 14 aa, Homo sapiens
CASSLGAGTGELFF

SEQ ID NO: 2867 - protein, 13 aa, Homo sapiens
CASSLGAPYEQYF

SEQ ID NO: 2868 - protein, 14 aa, Homo sapiens
CASSLGTGTDTQYF

SEQ ID NO: 2869 - protein, 13 aa, Homo sapiens
CASSLGTSDEQFF

SEQ ID NO: 2870 - protein, 16 aa, Homo sapiens
CASSLLDGGSYNEQFF

SEQ ID NO: 2871 - protein, 15 aa, Homo sapiens
CASSLPGGSSYEQYF

SEQ ID NO: 2872 - protein, 14 aa, Homo sapiens
CASSLQQGWYEQYF

SEQ ID NO: 2873 - protein, 12 aa, Homo sapiens
CASSLRPNEQFF

SEQ ID NO: 2874 - protein, 15 aa, Homo sapiens
CASSLRQGPSYEQYF

SEQ ID NO: 2875 - protein, 14 aa, Homo sapiens
CASSLTGMNTEAFF

SEQ ID NO: 2876 - protein, 17 aa, Homo sapiens
CASSLVGLGSSYNEQFF

SEQ ID NO: 2877 - protein, 12 aa, Homo sapiens
CASSLVNSPLHF

SEQ ID NO: 2878 - protein, 16 aa, Homo sapiens
CASSLVVRGGQETQYF

SEQ ID NO: 2879 - protein, 17 aa, Homo sapiens
CASSLYLWGEGQNEQFF

SEQ ID NO: 2880 - protein, 17 aa, Homo sapiens
CASSLYLWGEGQNEQFF

SEQ ID NO: 2881 - protein, 15 aa, Homo sapiens
CASSPDRGWDTEAFF

SEQ ID NO: 2882 - protein, 15 aa, Homo sapiens
CASSPGANGADTIYF

SEQ ID NO: 2883 - protein, 12 aa, Homo sapiens
CASSPGHTEAFF

SEQ ID NO: 2884 - protein, 11 aa, Homo sapiens
CASSPGIEQYF

SEQ ID NO: 2885 - protein, 16 aa, Homo sapiens
CASSPGLAGTYNEQFF

SEQ ID NO: 2886 - protein, 15 aa, Homo sapiens
CASSPGLIGTGELFF

SEQ ID NO: 2887 - protein, 17 aa, Homo sapiens
CASSPLRGDSPYNEQFF

SEQ ID NO: 2888 - protein, 14 aa, Homo sapiens
CASSPPTGNGELFF

SEQ ID NO: 2889 - protein, 15 aa, Homo sapiens
CASSPRTERTDTQYF

SEQ ID NO: 2890 - protein, 15 aa, Homo sapiens
CASSPTAGTRYEQYF

SEQ ID NO: 2891 - protein, 12 aa, Homo sapiens
CASSQDGYEQYF

SEQ ID NO: 2892 - protein, 16 aa, Homo sapiens
CASSQEAGLLYNEQFF

SEQ ID NO: 2893 - protein, 14 aa, Homo sapiens
CASSQEVGWETQYF

SEQ ID NO: 2894 - protein, 14 aa, Homo sapiens
CASSRWADTNEQFF

SEQ ID NO: 2895 - protein, 12 aa, Homo sapiens
CASSSFSYEQYF

SEQ ID NO: 2896 - protein, 15 aa, Homo sapiens
CASSSGAGAGYEQYF

SEQ ID NO: 2897 - protein, 12 aa, Homo sapiens
CASSSTAIEQFF

SEQ ID NO: 2898 - protein, 20 aa, Homo sapiens
CASSSWTSGSSESSYNEQFF

SEQ ID NO: 2899 - protein, 20 aa, Homo sapiens
CASSSWTSGSSESSYNEQFF

SEQ ID NO: 2900 - protein, 12 aa, Homo sapiens
CASSTPPGEQYF

SEQ ID NO: 2901 - protein, 14 aa, Homo sapiens
CASSVGGDTGELFF

SEQ ID NO: 2902 - protein, 15 aa, Homo sapiens
CASSWGGGANTEAFF

SEQ ID NO: 2903 - protein, 15 aa, Homo sapiens
CASSYGKGLYNEQFF

SEQ ID NO: 2904 - protein, 11 aa, Homo sapiens
CASSYGREAFF

SEQ ID NO: 2905 - protein, 15 aa, Homo sapiens
CASSYLGQLTDTQYF

SEQ ID NO: 2906 - protein, 12 aa, Homo sapiens
CASSYRTGELFF

SEQ ID NO: 2907 - protein, 12 aa, Homo sapiens
CASSYRTGELFF

SEQ ID NO: 2908 - protein, 16 aa, Homo sapiens
CASSYSGTGIFNEQFF

SEQ ID NO: 2909 - protein, 14 aa, Homo sapiens
CASTAGLATGELFF

SEQ ID NO: 2910 - protein, 16 aa, Homo sapiens
CASTITAGQVNYEQYF

SEQ ID NO: 2911 - protein, 14 aa, Homo sapiens
CASTLRVGVGELFF

SEQ ID NO: 2912 - protein, 16 aa, Homo sapiens
CATNYGLETGGYEQYF

SEQ ID NO: 2913 - protein, 13 aa, Homo sapiens
CATSPAIYNEQFF

SEQ ID NO: 2914 - protein, 14 aa, Homo sapiens
CAWSVGEAAYEQYF

SEQ ID NO: 2915 - protein, 12 aa, Homo sapiens
CSANDAPGGYTF

SEQ ID NO: 2916 - protein, 14 aa, Homo sapiens
CSAPSSGRYNEQFF

SEQ ID NO: 2917 - protein, 14 aa, Homo sapiens
CSAPTGVLVYGYTF

SEQ ID NO: 2918 - protein, 16 aa, Homo sapiens
CSARASGSSNTGELFF

SEQ ID NO: 2919 - protein, 13 aa, Homo sapiens
CSARDRGSYEQYF

SEQ ID NO: 2920 - protein, 13 aa, Homo sapiens
CSARSQGDYEQYF

SEQ ID NO: 2921 - protein, 13 aa, Homo sapiens
CSARSTGFYEQYF

SEQ ID NO: 2922 - protein, 14 aa, Homo sapiens
CSVDWVREQETQYF

SEQ ID NO: 2923 - protein, 14 aa, Homo sapiens
CSVERAWKQTEAFF

SEQ ID NO: 2924 - protein, 13 aa, Homo sapiens
CSVPSRMNTEAFF

SEQ ID NO: 2925 - protein, 15 aa, Homo sapiens
WATIFSGTGKIDHFF

SEQ ID NO: 2926 - protein, 12 aa, Homo sapiens
CAIMDRSYEQYF

SEQ ID NO: 2927 - protein, 17 aa, Homo sapiens
CAIRSLAGETPYNEQFF

SEQ ID NO: 2928 - protein, 13 aa, Homo sapiens
CARDPEEANVLTF

SEQ ID NO: 2929 - protein, 15 aa, Homo sapiens
CASGDGSTGGETQYF

SEQ ID NO: 2930 - protein, 15 aa, Homo sapiens
CASPPLNRGENEQFF

SEQ ID NO: 2931 - protein, 13 aa, Homo sapiens
CASQGLAGDTQYF

SEQ ID NO: 2932 - protein, 12 aa, Homo sapiens
CASRDRRNTIYF

SEQ ID NO: 2933 - protein, 16 aa, Homo sapiens
CASRLLAGVPSDEQFF

SEQ ID NO: 2934 - protein, 15 aa, Homo sapiens
CASSADRGLIQPQHF

SEQ ID NO: 2935 - protein, 15 aa, Homo sapiens
CASSATGGFTDTQYF

SEQ ID NO: 2936 - protein, 11 aa, Homo sapiens
CASSDAKEQYF

SEQ ID NO: 2937 - protein, 11 aa, Homo sapiens
CASSDAKEQYF

SEQ ID NO: 2938 - protein, 12 aa, Homo sapiens
CASSDHGPGQYF

SEQ ID NO: 2939 - protein, 16 aa, Homo sapiens
CASSEAHWDRQETQYF

SEQ ID NO: 2940 - protein, 15 aa, Homo sapiens
CASSFGTGRSGELFF

SEQ ID NO: 2941 - protein, 16 aa, Homo sapiens
CASSFSGDPGANVLTF

SEQ ID NO: 2942 - protein, 13 aa, Homo sapiens
CASSGRWYNEQFF

SEQ ID NO: 2943 - protein, 17 aa, Homo sapiens
CASSHAGGSRGTGELFF

SEQ ID NO: 2944 - protein, 14 aa, Homo sapiens
CASSIGTLNTEAFF

SEQ ID NO: 2945 - protein, 14 aa, Homo sapiens
CASSIGTLNTEAFF

SEQ ID NO: 2946 - protein, 11 aa, Homo sapiens
CASSLADTQYF

SEQ ID NO: 2947 - protein, 12 aa, Homo sapiens
CASSLDKDTQYF

SEQ ID NO: 2948 - protein, 15 aa, Homo sapiens
CASSLDSASYNEQFF

SEQ ID NO: 2949 - protein, 18 aa, Homo sapiens
CASSLDSISYSGANVLTF

SEQ ID NO: 2950 - protein, 13 aa, Homo sapiens
CASSLEGLNEQFF

SEQ ID NO: 2951 - protein, 16 aa, Homo sapiens
CASSLEREMNTGELFF

SEQ ID NO: 2952 - protein, 15 aa, Homo sapiens
CASSLESDSPYEQYF

SEQ ID NO: 2953 - protein, 16 aa, Homo sapiens
CASSLGLAGYTGELFF

SEQ ID NO: 2954 - protein, 13 aa, Homo sapiens
CASSLLQGNIQYF

SEQ ID NO: 2955 - protein, 14 aa, Homo sapiens
CASSLPTGEQPQHF

SEQ ID NO: 2956 - protein, 14 aa, Homo sapiens
CASSLSSGRYEQYF

SEQ ID NO: 2957 - protein, 14 aa, Homo sapiens
CASSLSSGRYEQYF

SEQ ID NO: 2958 - protein, 15 aa, Homo sapiens
CASSPGLDPYHEQFF

SEQ ID NO: 2959 - protein, 15 aa, Homo sapiens
CASSPGLDPYNEQFF

SEQ ID NO: 2960 - protein, 15 aa, Homo sapiens
CASSPGLDPYNEQFF

SEQ ID NO: 2961 - protein, 15 aa, Homo sapiens
CASSPGLDPYNEQFF

SEQ ID NO: 2962 - protein, 16 aa, Homo sapiens
CASSPLAGGPQNEQFF

SEQ ID NO: 2963 - protein, 16 aa, Homo sapiens
CASSPQPGLGAETQYF

SEQ ID NO: 2964 - protein, 16 aa, Homo sapiens
CASSPQSYRVDQPQHF

SEQ ID NO: 2965 - protein, 15 aa, Homo sapiens
CASSQDGGDTDTQYF

SEQ ID NO: 2966 - protein, 15 aa, Homo sapiens
CASSQDGGDTDTQYF

SEQ ID NO: 2967 - protein, 14 aa, Homo sapiens
CASSQDQGIIEAFF

SEQ ID NO: 2968 - protein, 14 aa, Homo sapiens
CASSQESLNTEAFF

SEQ ID NO: 2969 - protein, 14 aa, Homo sapiens
CASSQESLNTEAFF

SEQ ID NO: 2970 - protein, 13 aa, Homo sapiens
CASSRERYNEQFF

SEQ ID NO: 2971 - protein, 12 aa, Homo sapiens
CASSSANYGYTF

SEQ ID NO: 2972 - protein, 13 aa, Homo sapiens
CASSSVPYNEQFF

SEQ ID NO: 2973 - protein, 18 aa, Homo sapiens
CASSVGGLAVSSGNTIYF

SEQ ID NO: 2974 - protein, 15 aa, Homo sapiens
CASSWVGDYQETQYF

SEQ ID NO: 2975 - protein, 14 aa, Homo sapiens
CASSYLGATNEAFF

SEQ ID NO: 2976 - protein, 17 aa, Homo sapiens
CASSYSKGLADSYEQYF

SEQ ID NO: 2977 - protein, 16 aa, Homo sapiens
CASSYSSRTGQETQYF

SEQ ID NO: 2978 - protein, 12 aa, Homo sapiens
CASTAPRGPQHF

SEQ ID NO: 2979 - protein, 13 aa, Homo sapiens
CASTGSIFNEQFF

SEQ ID NO: 2980 - protein, 13 aa, Homo sapiens
CASTLGQTGELFF

SEQ ID NO: 2981 - protein, 16 aa, Homo sapiens
CASTNGLAGVEGELFF

SEQ ID NO: 2982 - protein, 14 aa, Homo sapiens
CASYGRVSTGELFF

SEQ ID NO: 2983 - protein, 14 aa, Homo sapiens
CASYGRVSTGELFF

SEQ ID NO: 2984 - protein, 14 aa, Homo sapiens
CATGTGDSNQPQHF

SEQ ID NO: 2985 - protein, 14 aa, Homo sapiens
CATGTSGYRETQYF

SEQ ID NO: 2986 - protein, 17 aa, Homo sapiens
CATHEASGKWGQETQYF

SEQ ID NO: 2987 - protein, 16 aa, Homo sapiens
CATSDSPGQGSGELFF

SEQ ID NO: 2988 - protein, 17 aa, Homo sapiens
CATSPGTSGRLSNEQFF

SEQ ID NO: 2989 - protein, 14 aa, Homo sapiens
CATVRKINTGELFF

SEQ ID NO: 2990 - protein, 12 aa, Homo sapiens
CAWKGEGAEQFF

SEQ ID NO: 2991 - protein, 15 aa, Homo sapiens
CSARSGTSAPYEQYF

SEQ ID NO: 2992 - protein, 15 aa, Homo sapiens
CSARSGTSAPYEQYF

SEQ ID NO: 2993 - protein, 12 aa, Homo sapiens
CSARTGGAEAFF

SEQ ID NO: 2994 - protein, 12 aa, Homo sapiens
CSARTGGAEAFF

SEQ ID NO: 2995 - protein, 12 aa, Homo sapiens
CSARTGGAEAFF

SEQ ID NO: 2996 - protein, 14 aa, Homo sapiens
CSASPGTDNSPLHF

SEQ ID NO: 2997 - protein, 17 aa, Homo sapiens
CSASRPRPGGGSYEQYF

SEQ ID NO: 2998 - protein, 15 aa, Homo sapiens
CSVEASGWGKDTQYF

SEQ ID NO: 2999 - protein, 15 aa, Homo sapiens
CASCDGTRESDIQYF

SEQ ID NO: 3000 - protein, 13 aa, Homo sapiens
CASGGFEKYGYTF

SEQ ID NO: 3001 - protein, 12 aa, Homo sapiens
CASRRGYNEQFF

SEQ ID NO: 3002 - protein, 15 aa, Homo sapiens
CASSEAAESNQPQHF

SEQ ID NO: 3003 - protein, 15 aa, Homo sapiens
CASSEGAGGLDTQYF

SEQ ID NO: 3004 - protein, 15 aa, Homo sapiens
CASSETGSSTDTQYF

SEQ ID NO: 3005 - protein, 15 aa, Homo sapiens
CASSEWTGDTGELFF

SEQ ID NO: 3006 - protein, 15 aa, Homo sapiens
CASSEWTGDTGELFF

SEQ ID NO: 3007 - protein, 13 aa, Homo sapiens
CASSFQGYTEAFF

SEQ ID NO: 3008 - protein, 15 aa, Homo sapiens
CASSFWGPDDSPLHF

SEQ ID NO: 3009 - protein, 17 aa, Homo sapiens
CASSGGSGSTFPNEQFF

SEQ ID NO: 3010 - protein, 16 aa, Homo sapiens
CASSIDADRGLGGYTF

SEQ ID NO: 3011 - protein, 13 aa, Homo sapiens
CASSIVQTNEQFF

SEQ ID NO: 3012 - protein, 16 aa, Homo sapiens
CASSLGTGEMNTEAFF

SEQ ID NO: 3013 - protein, 12 aa, Homo sapiens
CASSLVGEVSLF

SEQ ID NO: 3014 - protein, 12 aa, Homo sapiens
CASSLYGGELFF

SEQ ID NO: 3015 - protein, 15 aa, Homo sapiens
CASSPGQFDTGELFF

SEQ ID NO: 3016 - protein, 15 aa, Homo sapiens
CASSQDLTSGDEQFF

SEQ ID NO: 3017 - protein, 17 aa, Homo sapiens
CASSQDRRGVGWTEAFF

SEQ ID NO: 3018 - protein, 14 aa, Homo sapiens
CASSQDYVMDEQYF

SEQ ID NO: 3019 - protein, 12 aa, Homo sapiens
CASSSANYGYTF

SEQ ID NO: 3020 - protein, 13 aa, Homo sapiens
CASSWGADNEQFF

SEQ ID NO: 3021 - protein, 15 aa, Homo sapiens
CASSYGLAGSYEQYF

SEQ ID NO: 3022 - protein, 16 aa, Homo sapiens
CASSYSSDRVSDTQYF

SEQ ID NO: 3023 - protein, 16 aa, Homo sapiens
CASSYSSDRVSDTQYF

SEQ ID NO: 3024 - protein, 16 aa, Homo sapiens
CASSYSSDRVSDTQYF

SEQ ID NO: 3025 - protein, 14 aa, Homo sapiens
CASSYSTNSYEQYF

SEQ ID NO: 3026 - protein, 14 aa, Homo sapiens
CASSYSTSAYEQYF

SEQ ID NO: 3027 - protein, 15 aa, Homo sapiens
CASTAGAFTYNEQFF

SEQ ID NO: 3028 - protein, 16 aa, Homo sapiens
CASTAQGQIISYEQYF

SEQ ID NO: 3029 - protein, 14 aa, Homo sapiens
CATSRDMLTDTQYF

SEQ ID NO: 3030 - protein, 14 aa, Homo sapiens
CATSRDMLTDTQYF

SEQ ID NO: 3031 - protein, 13 aa, Homo sapiens
CATSSIPGEAIYF

SEQ ID NO: 3032 - protein, 13 aa, Homo sapiens
CATSSIPGEAIYF

SEQ ID NO: 3033 - protein, 13 aa, Homo sapiens
CATSSIPGEAIYF

SEQ ID NO: 3034 - protein, 13 aa, Homo sapiens
CATSTGQGYEQYF

SEQ ID NO: 3035 - protein, 15 aa, Homo sapiens
CATWGGAAGSYEQYF

SEQ ID NO: 3036 - protein, 13 aa, Homo sapiens
CSAGQGESSPLHF

SEQ ID NO: 3037 - protein, 13 aa, Homo sapiens
CSAPGQPYNEQFF

SEQ ID NO: 3038 - protein, 13 aa, Homo sapiens
CSAQGLYPNEQFF

SEQ ID NO: 3039 - protein, 11 aa, Homo sapiens
CSAREDYEQYF

SEQ ID NO: 3040 - protein, 12 aa, Homo sapiens
CSARGDEETQYF

SEQ ID NO: 3041 - protein, 15 aa, Homo sapiens
CSASFETELNQPQHF

SEQ ID NO: 3042 - protein, 13 aa, Homo sapiens
CSASSLAGNEQFF

SEQ ID NO: 3043 - protein, 13 aa, Homo sapiens
CSASSLAGNEQFF

SEQ ID NO: 3044 - protein, 13 aa, Homo sapiens
CSASSLAGNEQFF

The invention claimed is:

1. A synthesized cDNA, comprising:
    (1) a first nucleotide sequence encoding a complementarity determining region 3 (CDR3) of a Vβ chain of a T-cell receptor (TCR) of a WTI-specific HLA-A*0201-positive cytotoxic T-cell (CTL), wherein the CDR3 confers diversity and specificity of WT1-antigen recognition of the CTL, or
    (2) a second nucleotide sequence that is complementary to the first nucleotide sequence,
    wherein the cDNA is obtained by reverse transcription of RNA of an HLA-A*0201-WT1$_{126\text{-}134}$ tetramer$^+$CD3$^+$CD8$^+$ cell.

2. The cDNA according to claim 1, wherein the cDNA consists of:
    (1) the first nucleotide sequence, or
    (2) the second nucleotide sequence.

3. The cDNA according to claim 1, wherein the cDNA is labelled.

4. The cDNA according to claim 1, comprising (1) the first nucleotide sequence.

5. The cDNA according to claim 1, comprising (2) the second nucleotide sequence.

6. A chip comprising a plurality of different isolated polynucleotides immobilized on the chip, each of the plurality of different isolated polynucleotides immobilized on the chip comprising:
    a cDNA sequence encoding an entire amino acid sequence of a complementarity determining region 3 (CDR3) of a Vβ chain of a T-cell receptor (TCR) of a WT1-specific HLA-A*0201-positive cytotoxic T-cell (CTL);
    an RNA sequence of a nucleotide that is complementary to the full length of the cDNA sequence; or
    a DNA sequence of the nucleotide that is complementary to the full length of the cDNA sequence.

7. The chip according to claim 6, wherein the isolated polynucleotides further comprise a label.

8. The chip according to claim 1, wherein the label is selected from the group consisting of a fluorescent label, a radioactive label, an enzyme label, and a chromophore label.

9. The chip according to claim 7, further comprising a labeled or unlabeled sample placed on the chip.

10. The chip according to claim 6, further comprising a labeled sample placed on the chip.

* * * * *